United States Patent
Davuluri et al.

(10) Patent No.: US 10,113,201 B2
(45) Date of Patent: Oct. 30, 2018

(54) METHODS AND COMPOSITIONS FOR DIAGNOSIS OF GLIOBLASTOMA OR A SUBTYPE THEREOF

(71) Applicants: The Wistar Institute of Anatomy and Biology, Philadelphia, PA (US); The Trustees of the University of Pennsylvania, Philadelphia, PA (US)

(72) Inventors: Ramana V. Davuluri, Haverford, PA (US); Sharmistha Pal, Downingtown, PA (US); Yingtao Bi, Philadelphia, PA (US); Louise C. Showe, Media, PA (US); Donald M. O'Rourke, Wynnewood, PA (US); Luke Macyszyn, Philadelphia, PA (US)

(73) Assignees: The Wistar Institute of Anatomy and Biology, Philadelphia, PA (US); The Trustees of the University of Pennsylvania, Philadelphia, PA (US)

( * ) Notice: Subject to any disclaimer, the term of this patent is extended or adjusted under 35 U.S.C. 154(b) by 0 days.

(21) Appl. No.: 14/782,116

(22) PCT Filed: Apr. 4, 2014

(86) PCT No.: PCT/US2014/032966
§ 371 (c)(1),
(2) Date: Oct. 2, 2015

(87) PCT Pub. No.: WO2014/165753
PCT Pub. Date: Oct. 9, 2014

(65) Prior Publication Data
US 2016/0060704 A1 Mar. 3, 2016

Related U.S. Application Data

(60) Provisional application No. 61/808,878, filed on Apr. 5, 2013, provisional application No. 61/937,215, filed on Feb. 7, 2014.

(51) Int. Cl.
*C12Q 1/68* (2018.01)
*C12Q 1/6886* (2018.01)

(52) U.S. Cl.
CPC ...... *C12Q 1/6886* (2013.01); *C12Q 2600/112* (2013.01); *C12Q 2600/118* (2013.01); *C12Q 2600/158* (2013.01); *C12Q 2600/16* (2013.01)

(58) Field of Classification Search
None
See application file for complete search history.

(56) References Cited

U.S. PATENT DOCUMENTS 6,248,526 B1 * 6/2001 Weimer ............... C12Q 1/6846
435/183
2001/0053519 A1 * 12/2001 Fodor ................. B01J 19/0046
435/6.11

2010/0167939 A1 7/2010 Aldape et al.
2011/0105340 A1 5/2011 Tian et al.
2012/0003209 A1 * 1/2012 Tran ..................... C12N 15/113
424/133.1

OTHER PUBLICATIONS

Korshunov (Acta Neuopathol 2006 vol. 111 p. 465).*
NEB catalog (1998/1999 pp. 121, 284).*
Rhee (Applied and Environmental Microbiology Jul. 2004 p. 4303).*
Zhang, Z. et al., Isoform level expression profiles provide better cancer signatures than gene level expression profiles, Genome Medicine, Apr. 2013, 5(33): 1-13.
Zhang, Z. et al., Unique Genome-Wide Map of TCF4 and STAT3 Targets Using ChIP-seq reveals their association with new molecular subtypes of glioblastoma, Neuro-Oncology, Jan. 2013, 15(3): 279-289.
Zhang, Z. et al., HOTAIR, a cell cycle-associated long noncoding RNA and a strong predictor of survival, is preferentially expressed in classical and mesenchymal glioma, Neuro-Oncology, Nov. 2013, 15(12): 1595-1603.
GenBank Direct Submission AF490843, *Homo sapiens* clone PAC 70L19, HOXC gene cluster. Mar. 2003.
Magalhaes, A.X., The transcriptome of the Oncogenic HOXA9 homeoprotein in human glioblastoma: functional and clinical relevance, Jan. 2013 (Abstract).
International Search Report dated Sep. 10, 2014 in corresponding International Patent Application No. PCT/US2014/32966 filed Apr. 4, 2014.
Written Opinion dated Sep. 10, 2014 in corresponding International Patent Application No. PCT/US2014/32966 filed Apr. 4, 2014.
Dunn, G.P. et al., Emerging insights into the molecular and cellular basis of glioblastoma, Genes & Development, Apr. 2012, 26(8): 756-784.
Vitucci, M. et al., Gene expression profiling of gliomas: merging genomic and histopathological classification for personalised therapy, British Journal of Cancer, Nov. 2010, 104: 545-553.
Verhaak, R.G. et al., An integrated genomic analysis identifies clinically relevant subtypes of glioblastoma characterized by abnormalities in PDGFRA, IDH1, EGFR and NF1, Cancer Cell, Jan. 2010, 17(1): 98-110.
Li, A. et al., Unsupervised Analysis of Transcriptomic Profiles Reveals Six Glioma Subtypes, Cancer Research, Mar. 2009, 69(5): 2091-2099.

(Continued)

*Primary Examiner* — Katherine D Salmon
(74) *Attorney, Agent, or Firm* — Howson & Howson LLP

(57) ABSTRACT

An isoform-level gene panel is disclosed that can accurately classify a glioblastoma subtype from a tumor sample. Such an isoform level gene panel comprises the 121 to 214 target isoforms identified in Table 1. Also disclosed are reagents for quantitatively detecting the expression or activity of the target isoforms of Table 1 in a patient sample. For example, such ligands can be PCR primer and probes sets. This isoform-level gene panel and reagents for detection of the isoforms are useful in an isoform-level assay for diagnosis of the molecular subtype of a glioblastoma in a patient. The assay employs algorithms and a novel computer program that performs the functions of FIG. 8. In one aspect, the assay is a high-throughput format.

7 Claims, 17 Drawing Sheets
Specification includes a Sequence Listing.

(56) References Cited

OTHER PUBLICATIONS

Olson, S. and Berger, A.C., Genome-Based Diagnostics: Clarifying Pathways to Clinical Use: Workshop Summary, Mar. 2012.
Bemmo, A. et al., Exon-Level Transcriptome Profiling in Murine Breast Cancer Reveals Splicing Changes Specific to Tumors with Different Metastatic Abilities, PLoS One, Aug. 2010, 5(8): e11981.
Boidot, R. et al., Predictive value of survivin alternative transcript expression in locally advanced breast cancer patients treated with neoadjuvant chemotherapy, International Journal of Molecular Medicine, Dec. 2008, 23: 285-291.
Lapuk, A. et al., Exon-level microarray analyses identify alternative splicing programs in breast cancer, Molecular Cancer Research, Jul. 2010, 8(7): 961-974.
Misquitta-Ali, C.M. et al., Global Profiling and Molecular Characterization of Alternative Splicing Events Misregulated in Lung Cancer, Molecular and Cellular Biology, Jan. 2011, 31(1): 138-150.
Wang, L. et al., SF3B1 and Other Novel Cancer Genes in Chronic Lymphocytic Leukemia, The New England Journal of Medicine, Dec. 2011, 365(26): 2497-2506.
Friboulet, L. et al., ERCC1 Isoform Expression and Repair in Non-Small-Cell Lung Cancer, The New England Journal of Medicine, Mar. 2013, 368(12): 1101-1110.
Turro, E. et al., MMBGX: a method for estimating expression at the isoform level and detecting differential splicing using whole-transcript Affymetrix arrays, Nucleic Acids Research, Oct. 2009, 38(1): e4.
Workman, C. et al., A new non-linear normalization method for reducing variability in DNA microarray experiments, Genome Biology, Aug. 2002, 3(9): research0048.1-0048.16.
Gaujoux, R and Seoighe, C., A Flexible R Package for Nonnegative Matrix Factorization, BMC Bioinformatics, Jul. 2010, 11: 367.
Diaz-Uriarte, R. and Alvarez De Andres, Gene selection and classification of microarray data using random forest, BMC Bioinformatics, Jan. 2006, 7(3): 1-13 doi:10.1186/1471-2105-7-3.
Breiman, L, Random Forests, Machine Learning, Oct. 2001, 45(1): 5-32.
Rousseeuw, P.J., Silhouettes: a graphical aid to the interpretation and validation of cluster analysis, Journal of Computational and Applied Mathematics, Nov. 1986, 20: 53-65.
Liu, H. et al., Discretization: An Enabling Technique, Data Mining and Knowledge Discovery, Oct. 2002, 6(4): 393-423.
Brennan, C. et al., Glioblastoma Subclasses Can Be Defined by Activity among Signal Transduction Pathways and Associated Genomic Alterations, PLoS One, Nov. 2009, 4(11): e7752.
Lu, K.V. et al., VEGF inhibits tumor cell invasion and mesenchymal transition through a MET/VEGFR2 complex, Cancer Cell, Jul. 2012, 22(1): 21-35.
Lee, Y. et al., Gene expression analysis of glioblastomas identifies the major molecular basis for the prognostic benefit of younger age, BMC Medical Genomics, Oct. 2008, 1:52.
Feero, W.G. et al., Genomic Medicine—An Updated Primer, The New England Journal of Medicine, May 2010, 362(21): 2001-2011.
McDermott, U. et al., Genomics and the Continuum of Cancer Care, The New England Journal of Medicine, Jan. 2011, 364(4): 340-350.
Pal, S. et al., Alternative transcription exceeds alternative splicing in generating the transcriptome diversity of cerebellar development, Genome Research, May 2011, 21: 1260-1272.
Phillips, H.S. et al., Molecular subclasses of high-grade glioma predict prognosis, delineate a pattern of disease progression, and resemble stages in neurogenesis, Cancer Cell, Mar. 2006, 9: 157-173.
Shen, R. et al., Integrative Subtype Discovery in Glioblastoma Using iCluster, PLoS One, Apr. 2012, 7(4): e35236.
Sturm, D. et al., Hotspot Mutations in H3F3A and IDH1 Define Distinct Epigenetic and Biological Subgroups of Glioblastoma, Cancer Cell, Oct. 2012, 22: 425-437.
Liang, Y. et al., Gene expression profiling reveals molecularly and clinically distinct subtypes of glioblastoma multiforme, PNAS, Apr. 2005, 102(16): 5814-5819.
Shirahata, M. et al., Gene Expression-BasedMolecular Diagnostic SystemforMalignant Gliomas Is Superior to Histological Diagnosis, Dec. 2007, 13(14): 7341-7356.
Yan, H. et al., IDH1 and IDH2 Mutations in Gliomas, The New England Journal of Medicine, Feb. 2009, 360(8): 765-773.
Hayden, E.C., Life is Complicated, Nature, Apr. 2010, 464: 664-667.
Warnat, P. et al., Cross-platform analysis of cancer microarray data improves gene expression based classification of phenotypes, BMC Bioinformatics, Nov. 2005, 6: 265.
Manilich, E. et al., Classification of large microarray datasets using fast random forest construction, Journal of Bioinformatics and Computational Biology, Apr. 2011, 9: 251-267.
Pal, S. et al., Isoform-level gene signature improves prognostic stratification and accurately classifies glioblastoma subtypes, Nucleic Acids, Jan. 2014, 42(3): 1-11.
International Preliminary Report on Patentability dated Oct. 15, 2015 in corresponding International Application No. PCT/US14/32966 filed on Apr. 4, 2014.
Ward, D. C. and Reich, E., Fluorescence Studies of Nucleotides and Polynucleotides, The Journal of Biological Chemistry, Mar. 1969, 244(5):1228-1237.
Walsh, J. M. and Beuning, P. J., Synthetic Nucleotides as Probes of DNA Polymerase Specificity, Journal of Nucleic, Jan. 2012, 2012(Article ID 530963):1-17.
Robins, R. K. et al., Structure of the nucleoside Antibioitics Formycin, Formycin B and Laurosin (1), J. Heterocyclic Chem, Mar. 1966, 3:110-114.

\* cited by examiner

Figure 1A
Figure 1B
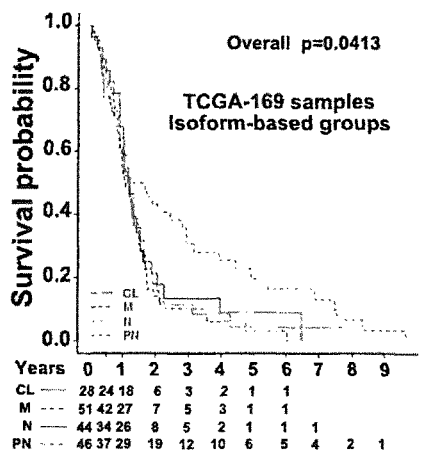
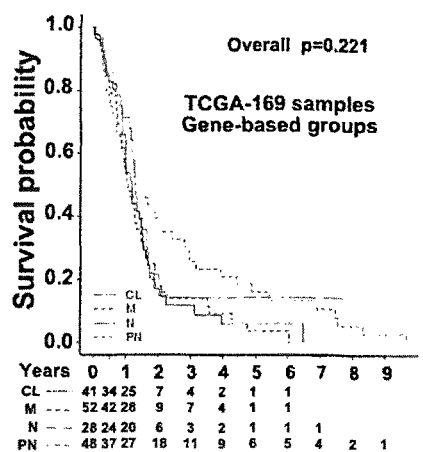
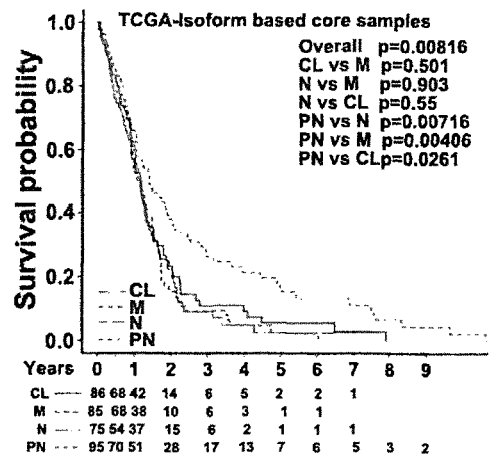
Figure 2

Figure 3A
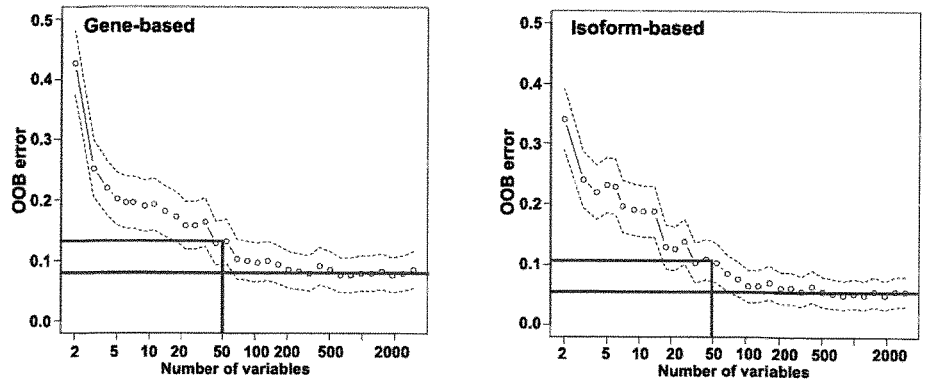
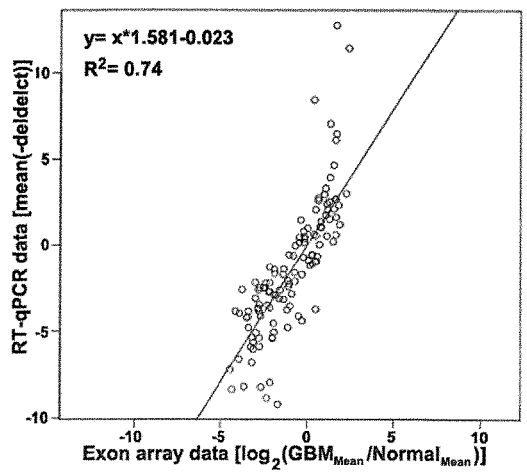
Figure 3B
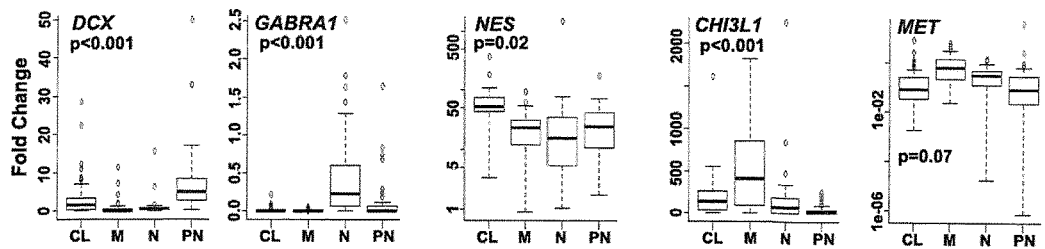
Figure 3C

```
######### ##########################discretization(FCCV values)
and feature selection
############## dividing the whole data set into training and
testing t1<-sample(rownames(nmfclu2)[nmfclu2$nmf==1],19) #
t2<-sample(rownames(nmfclu2)[nmfclu2$nmf==2],24)   ##
t3<-sample(rownames(nmfclu2)[nmfclu2$nmf==3],21) ##
t4<-sample(rownames(nmfclu2)[nmfclu2$nmf==4],21) ### tr1<-setdiff(rownames(nmfclu2)[nmfclu2$nmf==1],t1)
tr2<-setdiff(rownames(nmfclu2)[nmfclu2$nmf==2],t2)
tr3<-setdiff(rownames(nmfclu2)[nmfclu2$nmf==3],t3)
tr4<-setdiff(rownames(nmfclu2)[nmfclu2$nmf==4],t4)

### the feature selection is conducted on training data set
nsel=3000
datt.allgbm.cv3 = datt.allgbm[1:nsel,]

training <-datt.allgbm.cv3[,c(tr1,tr2,tr3,tr4)]
testing  <-datt.allgbm.cv3[,c(t1,t2,t3,t4)]

############################################### equal frequency
data discretization numbin=20 x<-t(training)
y<-nmfclu2[rownames(x),]
y<-as.factor(y)
 # value matrix
x<-apply(x,2,as.numeric)
x<-apply(x,2,rank)
xbin<-NULL
for (i in 1:dim(x)[2]) {
        temp<-cut(x[,i],breaks=numbin)
        temp<-as.numeric(temp)
)
        xbin<-cbind(xbin,temp)
}
colnames(xbin)<-colnames(x)
rownames(xbin)<-rownames(x)

######### end of discretization
```

Figure 16A

```
library(varSelRF)

#set.seed(1262118388.71279)
set.seed(24567)
rf <- varSelRF(xbin, y, ntree = 3000, ntreeIterat = 2000,
vars.drop.frac = 0.2, whole.range = TRUE,keep.forest = TRUE)
```

Figure 16A (continued)

```
loading required R packages
library(gplots)
library(cluster)

library(NMF)
library(survival)

##################################### Estimating the rank of
the data nsel <- 1600  ## the number of transcripts used for nmf clustering
datt.allgbm.cv3 = datt.allgbm[1:nsel,]  ###datt.allgbm is a data
matrix with rows indicating transcripts and column indicating samples.
#All the transcripts are sorted in descending order by cv values after
correlated ones filtered out.

datt.nmf=datt.allgbm.cv3 - min(datt.allgbm.cv3 )
estim.datt <- nmfEstimateRank(datt.nmf, range=2:7, nrun=100)

################### nmf clustering with 4 groups
res2all<-nmf(datt.nmf,4,nrun=50)
h2all <- coef(res2all)
nmfclu2<-apply(h2all,2,which.max) ## the clustering label for each
sample

####################################################################
Silhouette plot
eu.dist = as.dist(1-cor(datt.nmf))
sil.temp=silhouette(nmfclu2, eu.dist,)

lsams<-names(nmfclu2)[sil.temp[,3]>0] ## all the samples with positive
silhouette width nmfclu2<-as.data.frame(nmfclu2)
nmfclu2<-nmfclu2[lsams,,drop=FALSE]
colnames(nmfclu2)[1]<-"nmf"
table(nmfclu2$nmf)
```

Figure 16B

METHODS AND COMPOSITIONS FOR DIAGNOSIS OF GLIOBLASTOMA OR A SUBTYPE THEREOF

CROSS-REFERENCE TO RELATED APPLICATIONS

This application is a national stage of International Patent Application No. PCT/US2014/032966, filed Apr. 4, 2014, which claims the benefit of the priority of U.S. Provisional Patent Application No. 61/937,215, filed Feb. 7, 2014 and U.S. Provisional Patent Application No. 61/808,878, filed Apr. 5, 2013, which priority applications are incorporated herein by reference.

This invention was made with government support under grant Nos. P01LM011297 and P30CA010815 awarded by the National Institutes of Health. The government has certain rights in the invention.

SEQUENCE LISTING

Applicants hereby incorporates by reference the Sequence Listing material filed in electronic form herewith. This file is labeled WST141PCT_ST25.txt and contains 41,053 kb.

BACKGROUND OF THE INVENTION

Glioblastoma multiforme (GBM) are the most heterogeneous and lethal of the malignant adult brain tumors. Even with aggressive combination therapies, the prognosis of GBM remains dismal, with median survival of 15 months after diagnosis.[1]

Molecular classification of tumors is essential for developing personalized therapies. Although four distinct molecular subtypes have been identified by gene expression-based molecular classification of TCGA samples (i.e., Proneural (PN), Neural (N), Mesenchymal (M) and Classical (C))[3,4,33] the prognostic value of this stratification is weak and these subtypes contribute very little to the survival and prognostic stratification of GBMs.

Gene-level analysis of GBM has provided certain prospective gene signatures for the identification of GBM[3,4,28, 33-36]. For example, an 840-gene signature to predict the GBM subtypes was developed by the TCGA network,[3] but it is not yet translated to clinical practice. Despite considerable effort, no clinical diagnostic test for GBM subtyping is currently available.

SUMMARY OF THE INVENTION

In response to the urgent need in the art, the methods and compositions described herein provide an isoform-level expression signature that is useful in identifying novel molecular markers, as well as a more robust, reliable and clinically translatable genome-based diagnostic assay for improved clinical management of GBM patients, and GBM patient stratification useful to predict the molecular subtype of a GBM patient.

In one aspect, an isoform-level gene transcript panel is provided that can accurately classify a glioblastoma multiforme (GBM) subtype from a tumor sample.

In another aspect, a diagnostic reagent is provided that comprises the isoform level gene transcript panel of Table 1 or fragments thereof immobilized on a substrate, such as a microarray, a microfluidics card, a chip, a bead, or a chamber.

In yet a further aspect, a diagnostic reagent comprises a ligand capable of specifically complexing with, binding to, or quantitatively detecting or identifying a single target isoform transcript selected from the isoform transcripts of Table 1.

In another aspect, a kit, panel or microarray is provided, which comprises multiple such reagents, wherein at least one ligand is associated with a detectable label or with a substrate. In one embodiment, each reagent or ligand identifies the level of expression or activity of a different target isoform transcript of Table 1. In another embodiment, the, kit, panel or microarray comprises reagents that identify the level of expression or activity of all 121 "classifier" target isoform transcripts of Table 1. In another embodiment, the, kit, panel or microarray comprises reagents that identify the level of expression or activity of all 214 target isoform transcripts of Table 1. In a further embodiment, the kit, panel or microarray further comprises a ligand capable of specifically complexing with, binding to, or quantitatively detecting or identifying a control (upregulated or downregulated relative to normal) isoform transcript and/or a housekeeping gene or endogenous controls identified in Table 1. In still another embodiment, the kit, panel or microarray further comprises a ligand capable of specifically complexing with, binding to, or quantitatively detecting or identifying all of the isoform transcripts and controls identified in Table 1. In one embodiment, the ligand is an oligonucleotide sequence of about 20 nucleotides for use as a PCR primer or a pair of oligonucleotide sequences that form a primer pair or a labeled probe. Each primer or primer pair or probe in the kit, panel or microarray hybridizes to one of the isoform transcripts in Table 1.

In another aspect, the reagent, kit, panel or microarray further comprises computer software that performs the functions described in the flowchart of FIG. 8.

In yet another aspect, an isoform-level assay for diagnosis of the molecular subtype of a glioblastoma in a subject is provided. The assay comprises assaying a sample obtained from a subject that has or is suspected of having a glioblastoma by contacting the sample with an isoform transcript panel of Table 1 or a reagent, kit, panel or microarray of ligands capable of specifically complexing with, binding to, or quantitatively detecting or identifying the level or activity of target isoform transcripts selected from the isoforms of Table 1. In one aspect, this assaying step involves performing an RT-qPCR assay with ligands, e.g., PCR primer sets, and/or labeled probes directed to each target isoform transcript and controls identified in Table 1. The individual expression levels or activities of the target isoform transcripts relative to a reference standard are then analyzed in a program that performs the algorithms and functions of FIG. 8. This program then generates an isoform transcript signature that permits a diagnosis or prediction of that subject's GBM molecular subtype.

In one embodiment, this process is performed by a computer processor or computer-programmed instrument that generates numerical or graphical data useful in the diagnosis of the condition using the algorithms identified in FIG. 8.

In a further aspect, a computer program or source code is provided that performs the functions and uses the algorithm structure of the flow chart of FIG. 8.

Other aspects and advantages of these compositions and methods are described further in the following detailed description of the preferred embodiments thereof.

BRIEF DESCRIPTION OF THE DRAWINGS

FIG. 1A is a Kaplan-Meier survival curve for the overlapping TCGA study isoform-based core samples (169 GBM patients).

FIG. 1B is a Kaplan-Meier survival curves for the overlapping TCGA study core gene-based samples (169 GBM patients).

FIG. 2 is an isoform-based core samples from TCGA (342 GBM patients) belonging to the four subtypes identified as Proneural (PN), Neural (N), Mesenchymal (M) or Classical (C). The statistical significance of the overall plot and that of one-to-one comparison for each subtype is shown. The number of patients surviving for different time periods is also indicated below the survival plots.

FIG. 3A, having a left graph and a right graph, shows the development of an isoform/transcript-based classifier and its validation. The out-of-bag (OOB) error rate was plotted for a gene-based (left graph) and isoform-based (right graph) classifier model, where the x-axis denotes the number of variables or features and the y-axis represents the OOB error rate. The blue line forming a box in the left corner of each graph shows the OOB error rate for 50 features in each model, and the horizontal line depicts the lowest error rate achievable by the two models.

FIG. 3B is a graph showing the correlation of expression estimates obtained on two different cohorts of GBM patients on two different platforms. The x-axis represents the mean fold change for 121 transcripts/isoforms based on exon-array data for isoform-based core samples from TCGA, and the y-axis shows the mean fold change for the same transcripts/isoforms for Penn cohort of GBM patients based on RT-qPCR analysis. Both sets of data are $\log_2$ transformed. The equation for the linear relationship and the $R^2$ represented on the figure were calculated after removing the outliers.

FIG. 3C are five boxplots representing the expression as fold change of the indicated marker genes for the four different subtypes in each subtype of Penn cohort of GBM patients identified by the 121 isoform classifier of Table 1. For analysis of marker gene expression, the algorithm was applied by excluding these gene expression estimates from the classifier. Two out of 206 samples that changed classes were omitted from the boxplot analysis. The y-axis for NES and MET are shown in logarithmic scale. All fold changes were calculated relative to normal brain tissue.

FIG. 16A shows the R script as text files for the PIGEx-Class classification system data discretization feature.

FIG. 16B shows the R script as text files for the PIGEx-Class classification system NMF clustering feature.

DETAILED DESCRIPTION OF THE INVENTION

Figure 4A:
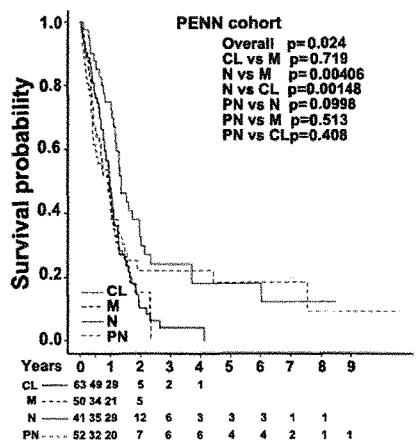
FIG. 4A is a Kaplan-Meier survival plot for Penn cohort of GBM patients with the overall survival curve for GBM patients who were classified into four subtypes by the 121 isoform classifier based on the RT-qPCR expression estimates. The statistical significance of each plot is indicated.

The complexity of the gene structure in the human genome and the importance of using alternative splice variants as molecular signatures towards genomic medicine are increasingly appreciated.[29-31] Alternative splicing is a commonly used molecular strategy for creating multiple gene isoforms and many of the isoforms produced in this manner are tightly regulated during normal development but are mis-regulated in cancer cells.[7,32] Using The Cancer Genome Atlas (TCGA) exon-array data, the inventors developed an isoform-level gene panel that could accurately classify the four GBM subtypes and isoform-level assay for using in the diagnosis of the subtypes of GBM. To the best of the inventors' knowledge, this is the first isoform-level assay for efficient molecular stratification of cancer. The isoform-level analysis described herein lead to a substantially better subtype prediction model than the gene-level analysus[3,4,28,33-36] in terms of improved classification accuracy, fewer numbers of variables (isoforms) in the final model, and statistically significant prognostic stratification of the refined subtypes. In contrast to the TCGA 840 gene signature for GBM, the inventor's isoform-based classifier can predict the GBM subtype with high accuracy using a much smaller gene panel (e.g., between 121 to 214 isoform transcripts), which was successfully transformed to an RT-qPCR-based assay.[37] The isoform-level classifiers and assay methods described herein provide a quantitative and reproducible diagnosis of GBM molecular subtypes, a requirement towards personalized medicine.

I. DEFINITIONS AND COMPONENTS OF THE COMPOSITIONS AND METHODS

"Patient" or "subject" as used herein means a mammalian animal, including a human, a veterinary or farm animal, a domestic animal or pet, and animals normally used for clinical research. In one embodiment, the subject of these methods and compositions is a human.

By "isoform" is meant an alternative expression product or variant of a single gene in a given species, including forms generated by alternative splicing, single nucleotide polymorphisms, alternative promoter usage, alternative translation initiation small genetic differences between alleles of the same gene. Genes produce alternative gene products through the usage of alternative promoters during development. Alternative gene isoforms display opposing expression patterns, nullifying the expression changes at the gene level. Frequently this expression pattern is reversed back in disease conditions of adult brain. Thus the target isoforms identified in Table 1 provide targets for the detection of brain disease, such as GMB.

By "target isoform" or "target isoform signature" as used herein is meant a single nucleotide acid sequence, e.g., RNA which the inventors have determined is useful as a classifier of GMB subtypes. The inventors have identified target isoform transcripts using in the GBM classifier as including the 121 isoform transcripts and corresponding genes listed in Table 1 and including the 93 isoform transcripts in the lower portion of Table 1. Throughout this specification, wherever the term target isoform transcript or combination of target isoform transcripts is used, it should be understood that the target isoform transcripts can be any of those identified in Table 1. The target isoforms may be combined to form sets of classifiers in the methods and diagnostic reagents described herein. In one embodiment, it is understood that all molecular forms useful in this context are physiological, e.g., naturally occurring in the species. The gene or transcript sequences are publically available. For example, they can be identified in the ENSEMBL database which is publically available as version 56 Alternatively, the transcripts are publically available from the UCSC Genome Browser version hg19 (see, e.g. Kent W J et al, "The human genome browser at UCSC." Genome Res., 2002 June; 12(6):996-1006).

TABLE 1

| ENSEMBL ENST# TRANSCRIPT ID/ (SEQ ID NO:) | GENE NAME or SYMBOL | CHRO-MOSOME # | NUCL. BASE START | NUCL BASE END | STRAND | ENSEMBL GENE ID (ENSG#) |
|---|---|---|---|---|---|---|
| ISOFORM TARGETS FORMING 121 ISOFORM SIGNATURE\ FOR DIAGNOSIS OF GMB ||||||||
| 00000276681 SEQ ID NO: 1 | MAL2 | 8 | 120220610 | 120257909 | 1 | 00000147676 |
| 00000467088 SEQ ID NO: 2 | CTTNBP2 | 7 | 117400322 | 117407245 | −1 | 00000077063 |
| 00000381158 SEQ ID NO: 3 | RAB3C | 5 | 57913336 | 58147405 | 1 | 00000152932 |
| 00000334389 SEQ ID NO: 4 | AL390816.1 | 14 | 62584075 | 62595132 | 1 | 00000186369 |
| 00000495883 SEQ ID NO: 5 | SNAP25 | 20 | 10276878 | 10288066 | 1 | 00000132639 |
| 00000470756 SEQ ID NO: 6 | ALCAM | 3 | 105085762 | 105244237 | 1 | 00000170017 |
| 00000378383 SEQ ID NO: 7 | FNDC3A | 13 | 49550205 | 49720983 | 1 | 00000102531 |

TABLE 1-continued

| ENSEMBL ENST# TRANSCRIPT ID/ (SEQ ID NO:) | GENE NAME or SYMBOL | CHROMOSOME # | NUCL. BASE START | NUCL BASE END | STRAND | ENSEMBL GENE ID (ENSG#) |
|---|---|---|---|---|---|---|
| 00000497227 SEQ ID NO: 8 | LRRC16A | 6 | 25465764 | 25472859 | 1 | 00000079691 |
| 00000463206 SEQ ID NO: 9 | PPAPR3 | 9 | 104032084 | 104075176 | 1 | 00000148123 |
| 00000498732 SEQ ID NO: 10 | RP1-177G6 | X | 139791945 | 139854839 | 1 | 00000203930 |
| 00000489023 SEQ ID NO: 11 | C2orf21 | 2 | 210693953 | 210835038 | 1 | 00000144406 |
| 00000425974 SEQ ID NO: 12 | AC064875.1 | 2 | 13106910 | 13147138 | −1 | 00000225649 |
| 00000424518 SEQ ID NO: 13 | HOTAIR | 12 | 54356092 | 54368740 | −1 | |
| 00000272644 SEQ ID NO: 14 | GPR17 | 2 | 128403747 | 128410213 | 1 | 00000144230 |
| 00000342358 SEQ ID NO: 15 | ATP13A5 | 3 | 192992579 | 193096632 | −1 | 00000187527 |
| 00000335523 SEQ ID NO: 16 | VSTM2B | 19 | 30017491 | 30054841 | 1 | 00000187135 |
| 00000020926 SEQ ID NO: 17 | SYT13 | 11 | 45261853 | 45307884 | −1 | 00000019505 |
| 00000180173 SEQ ID NO: 18 | MTMR7 | 8 | 17155552 | 17270836 | −1 | 00000003987 |
| 00000359598 SEQ ID NO: 135 | ELAVL2 | 9 | 23692025 | 23765104 | −1 | 00000107105 |
| 00000408006 SEQ ID NO: 136 | KLRK1 | 12 | 10598642 | 10602299 | −1 | 00000134545 |
| 00000437025 SEQ ID NO: 19 | GABRA1 | 5 | 161275542 | 161326965 | 1 | 00000022355 |
| 00000328405 SEQ ID NO: 20 | KCNH8 | 3 | 19189946 | 19577138 | 1 | 00000183960 |
| 00000436393 SEQ ID NO: 21 | AC107933.1 | 8 | 105080740 | 105161076 | 1 | 00000225388 |
| 00000311812 SEQ ID NO: 22 | SNX31 | 8 | 101585116 | 101661893 | −1 | 00000174226 |
| 00000378993 SEQ ID NO: 23 | IL1RAPL1 | X | 28605516 | 29974840 | 1 | 00000169306 |
| 00000233946 SEQ ID NO: 31 | IL1R1 | 2 | 102770402 | 102796334 | 1 | 00000115594 |
| 00000393845 SEQ ID NO: 32 | WDR52 | 3 | 113010404 | 113160340 | −1 | 00000206530 |
| 00000448418 SEQ ID NO: 33 | MPPED2 | 11 | 30406040 | 30607930 | −1 | 00000066382 |
| 00000341752 SEQ ID NO: 34 | ANKS1B | 12 | 99137996 | 99225920 | −1 | 00000185046 |
| 00000374778 SEQ ID NO: 35 | AP000843.1 | 11 | 132290087 | 133402219 | −1 | 00000183715 |
| 00000303177 SEQ ID NO: 36 | AC093310 | 5 | 173472663 | 173536189 | 1 | 00000170091 |
| 00000483004 SEQ ID NO: 37 | CFB | 6 | 31916733 | 31919830 | 1 | 00000243649 |
| 00000427482 SEQ ID NO: 38 | SH3GL3 | 15 | 84115980 | 84287495 | 1 | 00000140600 |
| 00000358763 SEQ ID NO: 39 | SYN3 | 22 | 32908539 | 33454358 | −1 | 00000185666 |
| 00000444190 SEQ ID NO: 40 | ARPP-21 | 3 | 35682456 | 35835949 | 1 | 00000172995 |
| 00000331565 SEQ ID NO: 41 | SLC6A17 | 1 | 110693108 | 110744824 | 1 | 00000197106 |
| 00000351273 SEQ ID NO: 42 | ACPP | 3 | 132036251 | 132087142 | 1 | 00000014257 |
| 00000414552 SEQ ID NO: 43 | GABRG2 | 5 | 161494648 | 161582545 | 1 | 00000113327 |
| 00000328439 SEQ ID NO: 44 | MYT1 | 20 | 62795827 | 62873604 | 1 | 00000196132 |
| 00000361727 SEQ ID NO: 45 | CNTNAP2 | 7 | 145813453 | 148118090 | 1 | 00000174469 |
| 00000356915 + 00000371988 SEQ ID NO: 46 | DCX | X | 110537007 | 110655406 | −1 | 00000077279 |
| 00000330884 SEQ ID NO: 47 | SULT4A1 | 22 | 44220389 | 44258383 | −1 | 00000130540 |
| 00000260227 SEQ ID NO: 48 | MMP7 | 11 | 102391268 | 102401458 | −1 | 00000137673 |

TABLE 1-continued

| ENSEMBL ENST# TRANSCRIPT ID/ (SEQ ID NO:) | GENE NAME or SYMBOL | CHRO-MOSOME # | NUCL. BASE START | NUCL BASE END | STRAND | ENSEMBL GENE ID (ENSG#) |
|---|---|---|---|---|---|---|
| 00000281156 SEQ ID NO: 49 | KHDRBS2 | 6 | 62390139 | 62996132 | −1 | 00000112232 |
| 00000350228 SEQ ID NO: 50 | KCNC2 | 12 | 75433896 | 75603511 | −1 | 00000166006 |
| 00000342916 SEQ ID NO: 51 | EGFR | 7 | 55086725 | 55236328 | 1 | 00000146648 |
| 00000354078 SEQ ID NO: 52 | MAL | 2 | 95691538 | 95719737 | 1 | 00000172005 |
| 00000303230 SEQ ID NO: 53 | HCN1 | 5 | 45259349 | 45696253 | −1 | 00000164588 |
| 00000334005 SEQ ID NO: 54 | PLCB4 | 20 | 9076932 | 9461460 | 1 | 00000101333 |
| 00000439649 SEQ ID NO: 55 | GFRA1 | 10 | 117816444 | 118032796 | −1 | 00000151892 |
| 00000392314 SEQ ID NO: 56 | TMEFF2 | 2 | 192813769 | 193059642 | −1 | 00000144339 |
| 00000439399 SEQ ID NO: 57 | SNAP91 | 6 | 84262607 | 84419127 | −1 | 00000065609 |
| 00000404301 SEQ ID NO: 58 | RGS6 | 14 | 72431509 | 73006978 | 1 | 00000182732 |
| 00000310157 + 00000424910 SEQ ID NO: 59 | KLK6 | 19 | 51461888 | 51472929 | −1 | 00000167755 |
| 00000219746 SEQ ID NO: 60 | TOX3 | 16 | 52471918 | 52580635 | −1 | 00000103460 |
| 00000357277 SEQ ID NO: 61 | REPS2 | X | 16964814 | 17171395 | 1 | 00000169891 |
| 00000370603 + 00000441825 SEQ ID NO: 62 | FGF13 | X | 137713740 | 138067246 | −1 | 00000129682 |
| 00000453976 SEQ ID NO: 63 | RIMS1 | 6 | 72960033 | 73112507 | 1 | 00000079841 |
| 00000215939 SEQ ID NO: 64 | CRYBB1 | 22 | 26995242 | 27014052 | −1 | 00000100122 |
| 00000262624 SEQ ID NO: 65 | MAG | 19 | 35783028 | 35804707 | 1 | 00000105695 |
| 00000285273 SEQ ID NO: 66 | CA10 | 17 | 49707675 | 50237161 | −1 | 00000154975 |
| 00000373434 SEQ ID NO: 67 | RALGPS1 | 9 | 129724504 | 129980091 | 1 | 00000136828 |
| 00000373965 + 00000414778 + 00000455746 SEQ ID NO: 68 | PCDH15 | 10 | 55562531 | 56561051 | −1 | 00000150275 |
| 00000370859 SEQ ID NO: 69 | SLC44A5 | 1 | 75667816 | 76076801 | −1 | 00000137968 |
| 00000299222 SEQ ID NO: 70 | AC079953.2 | 12 | 101188735 | 101522114 | 1 | 00000151572 |
| 00000492720 SEQ ID NO: 71 | DENND2A | 7 | 140243378 | 140305606 | −1 | 00000146966 |
| 00000294696 SEQ ID NO: 72 | HFM1 | 1 | 91726324 | 91870426 | −1 | 00000162669 |
| 00000424189 SEQ ID NO: 73 | DGKI | 7 | 137075270 | 137531838 | −1 | 00000157680 |
| 00000376888 SEQ ID NO: 74 | MOG | 6 | 29624780 | 29639888 | 1 | 00000204655 |
| 00000382275 SEQ ID NO: 75 | CDH18 | 5 | 19473141 | 19988339 | −1 | 00000145526 |
| 00000397752 SEQ ID NO: 76 | MET | 7 | 116312446 | 116438440 | 1 | 00000105976 |
| 00000453617 SEQ ID NO: 77 | NPNT | 4 | 106816605 | 106892824 | 1 | 00000168743 |
| 00000343508 SEQ ID NO: 78 | CSMD3 | 8 | 113235157 | 114389382 | −1 | 00000164796 |
| 00000373380 SEQ ID NO: 24 | CSMD2 | 1 | 34057407 | 34175104 | −1 | 00000121904 |
| 00000361655 + 00000395337 SEQ ID NO: 25 | PCDH11X | X | 91034304 | 91139006 | 1 | 00000102290 |
| 00000394755 SEQ ID NO: 26 | EVI2A | 17 | 29644676 | 29648717 | −1 | 00000126860 |
| 00000477310 SEQ ID NO: 27 | XXbac-BPG116M5 | 6 | 31895501 | 31919807 | 1 | 00000244255 |

TABLE 1-continued

| ENSEMBL ENST# TRANSCRIPT ID/ (SEQ ID NO:) | GENE NAME or SYMBOL | CHROMOSOME # | NUCL. BASE START | NUCL BASE END | STRAND | ENSEMBL GENE ID (ENSG#) |
|---|---|---|---|---|---|---|
| 00000495831 SEQ ID NO: 28 | MYO1G | 7 | 45002261 | 45018668 | −1 | 00000136286 |
| 00000358671 SEQ ID NO: 29 | FCGR2B | 1 | 161632951 | 161648444 | 1 | 00000072694 |
| 00000260126 SEQ ID NO: 30 | SLCO5A1 | 8 | 70584575 | 70747208 | −1 | 00000137571 |
| 00000256183 + 00000444303 SEQ ID NO: 133 | AMPD3 | 11 | 10472224 | 10529126 | 1 | 00000133805 |
| 00000375773 SEQ ID NO: 132 | KYNU | 2 | 143635226 | 143747106 | 1 | 00000115919 |
| 00000396023 SEQ ID NO: 131 | CRYM | 16 | 21269843 | 21289657 | −1 | 00000103316 |
| 00000435105 SEQ ID NO: 137 | FMOD | 1 | 203309753 | 203317340 | −1 | 00000122176 |
| 00000366621 SEQ ID NO: 130 | KCNK1 | 1 | 233749750 | 233808258 | 1 | 00000135750 |
| 00000370314 SEQ ID NO: 129 | GABRA3 | X | 151334706 | 151619830 | −1 | 00000011677 |
| 00000375108 SEQ ID NO: 128 | PLA2G5 | 1 | 20396701 | 20417661 | 1 | 00000127472 |
| 00000266674 SEQ ID NO: 127 | LGR5 | 12 | 71833813 | 71978622 | 1 | 00000139292 |
| 00000354567 + 00000370806 SEQ ID NO: 126 | AK5 | 1 | 77747736 | 78025650 | 1 | 00000154027 |
| 00000240618 SEQ ID NO: 125 | AC022075.1 | 12 | 10524953 | 10542640 | −1 | 00000213809 |
| 00000262095 + 00000491143 SEQ ID NO: 124 | ONECUT2 | 18 | 55102917 | 55158529 | 1 | 00000119547 |
| 00000273450 SEQ ID NO: 123 | ALDH1L1 | 3 | 125822412 | 125900029 | −1 | 00000144908 |
| 00000357742 SEQ ID NO: 122 | MCTP2 | 15 | 94774951 | 95023632 | 1 | 00000140563 |
| 00000404234 SEQ ID NO: 121 | SEZ6L | 22 | 26565440 | 26776437 | 1 | 00000100095 |
| 00000254765 SEQ ID NO: 120 | POPDC3 | 6 | 105606155 | 105627735 | −1 | 00000132429 |
| 00000217305 SEQ ID NO: 119 | PDYN | 20 | 1959405 | 1974703 | −1 | 00000101327 |
| 00000393913 SEQ ID NO: 118 | FAM176A | 2 | 75719444 | 75788039 | −1 | 00000115363 |
| 00000400457 SEQ ID NO: 117 | PCDH11Y | Y | 4924930 | 5610265 | 1 | 00000099715 |
| 00000380032 SEQ ID NO: 116 | C9orf11 | 9 | 27284659 | 27297137 | −1 | 00000120160 |
| 00000263665 SEQ ID NO: 115 | CNTN3 | 3 | 74311719 | 74570291 | −1 | 00000113805 |
| 00000332191 SEQ ID NO: 114 | ROBO2 | 3 | 77089881 | 77696267 | 1 | 00000185008 |
| 00000396884 SEQ ID NO: 113 | SOX10 | 22 | 38368307 | 38380544 | −1 | 00000100146 |
| 00000382622 SEQ ID NO: 112 | PRMT8 | 12 | 3600402 | 3703139 | 1 | 00000111218 |
| 00000370103 SEQ ID NO: 111 | OLFM3 | 1 | 102268130 | 102462586 | −1 | 00000118733 |
| 00000285105 SEQ ID NO: 134 | AIM1 | 6 | 106989093 | 107018335 | 1 | 00000112297 |
| 00000425955 + 00000458628 SEQ ID NO: 110 | CXorf35 | X | 100740462 | 100788446 | 1 | 00000196440 |
| 00000420628 SEQ ID NO: 109 | MMP19 | 12 | 56229244 | 56236735 | −1 | 00000123342 |
| 00000367053 SEQ ID NO: 108 | CR1 | 1 | 207669502 | 207813992 | 1 | 00000203710 |
| 00000264318 SEQ ID NO: 107 | GABRA4 | 4 | 46920917 | 46996424 | −1 | 00000109158 |
| 00000416284 SEQ ID NO: 106 | FAM19A2 | 12 | 62102045 | 62261212 | −1 | 00000198673 |
| 00000399232 SEQ ID NO: 105 | MDGA2 | 14 | 47309295 | 48143953 | −1 | 00000139915 |
| 00000376447 SEQ ID NO: 104 | RASEF | 9 | 85594500 | 85678043 | −1 | 00000165105 |

TABLE 1-continued

| ENSEMBL ENST# TRANSCRIPT ID/ (SEQ ID NO:) | GENE NAME or SYMBOL | CHRO- MOSOME # | NUCL. BASE START | NUCL BASE END | STRAND | ENSEMBL GENE ID (ENSG#) |
|---|---|---|---|---|---|---|
| 00000216492 SEQ ID NO: 103 | CHGA | 14 | 93389445 | 93401636 | 1 | 00000100604 |
| 00000369261 SEQ ID NO: 102 | KLHL32 | 6 | 97372605 | 97588630 | 1 | 00000186231 |
| 00000369574 SEQ ID NO: 101 | C6orf163 | 6 | 88054600 | 88075181 | 1 | 00000203872 |
| 00000379959 SEQ ID NO: 100 | IL2RA | 10 | 6052652 | 6104288 | −1 | 00000134460 |
| 00000392441 SEQ ID NO: 99 | CCDC62 | 12 | 123259073 | 123311929 | 1 | 00000130783 |
| 00000457059 SEQ ID NO: 98 | DYNC1I1 | 7 | 95433596 | 95727311 | 1 | 00000158560 |
| 00000392825 SEQ ID NO: 97 | GALNT13 | 2 | 154728426 | 155310361 | 1 | 00000144278 |
| 00000259056 SEQ ID NO: 96 | GALNT5 | 2 | 158114110 | 158170723 | 1 | 00000136542 |
| 00000371015 SEQ ID NO: 95 | PHACTR3 | 20 | 58179603 | 58422766 | 1 | 00000087495 |
| CONTROL GENE/TRANSCRIPTS ON ASSAY UPREGULATED IN ALL GBM RELATIVE TO NORMAL | | | | | | |
| 00000373020 SEQ ID NO: 94 | TSPAN6 | | | | | |
| 00000218340 SEQ ID NO: 93 | RP2 | | | | | |
| 00000483967 SEQ ID NO: 92 | EZH2 | | | | | |
| 00000263635 SEQ ID NO: 90 | TANC1 | | | | | |
| 00000450318 SEQ ID NO: 89 | NUSAP1 | | | | | |
| 00000411739 SEQ ID NO: 88 | NEDD1 | | | | | |
| 00000478293 SEQ ID NO: 87 | MKI67 | | | | | |
| 00000295633 SEQ ID NO: 86 | FSTL1 | | | | | |
| CONTROL GENE/TRANSCRIPTS ON ASSAY DOWNREGULATED IN ALL GBM RELATIVE TO NORMAL | | | | | | |
| 00000389722 SEQ ID NO: 85 + 00000389723 SEQ ID NO: 91 | SPTB | | | | | |
| 00000381142 SEQ ID NO: 84 | TYRP1 | | | | | |
| 00000369777 SEQ ID NO: 83 | NEURL | | | | | |
| 00000414191 + 00000439163 SEQ ID NO: 82 | PLCH1 | | | | | |
| 00000262450 SEQ ID NO: 81 | CHD5 | | | | | |
| 00000322893 SEQ ID NO: 80 | KCNH5 | | | | | |
| 00000304045 SEQ ID NO: 79 | KLK7 | | | | | |
| ENDOGENOUS CONTROLS | | | | | | |
| | GAPDH | | | | | |
| | POLR2A* | *used for normali- zation | | | | |
| | B2M | | | | | |
| | ACTB | | | | | |
| ADDITIONAL ISOFORM TARGETS FORMING ADDITIONAL SIGNATURES FOR DIAGNOSIS OF GMB | | | | | | |
| 00000216775 SEQ ID NO: 138 | CPNE6 | 14 | 24540756 | 24547295 | 1 | 00000100884 |
| 00000219368 SEQ ID NO: 139 | FA2H | 16 | 74746853 | 74808730 | −1 | 00000103089 |

TABLE 1-continued

| ENSEMBL ENST# TRANSCRIPT ID/ (SEQ ID NO:) | GENE NAME or SYMBOL | CHRO- MOSOME # | NUCL. BASE START | NUCL BASE END | STRAND | ENSEMBL GENE ID (ENSG#) |
|---|---|---|---|---|---|---|
| 00000221485 SEQ ID NO: 140 | SLC17A7 | 19 | 49932656 | 49944808 | -1 | 00000104888 |
| 00000225441 SEQ ID NO: 141 | RUNDC3A | 17 | 42385927 | 42395237 | 1 | 00000108309 |
| 00000242315 SEQ ID NO: 142 | KIAA1045 | 9 | 34958321 | 34982541 | 1 | 00000122733 |
| 00000256178 SEQ ID NO: 143 | LYVE1 | 11 | 10579413 | 10590365 | -1 | 00000133800 |
| 00000260795 SEQ ID NO: 144 | FGFR3 | 4 | 1795560 | 1810598 | 1 | 00000068078 |
| 00000261592 SEQ ID NO: 145 | NOL4 | 18 | 31431064 | 31803515 | -1 | 00000101746 |
| 00000262545 SEQ ID NO: 146 | PCSK2 | 20 | 17207636 | 17465223 | 1 | 00000125851 |
| 00000263050 SEQ ID NO: 147 | AKAP7 | 6 | 131571623 | 131604675 | 1 | 00000118507 |
| 00000263464 SEQ ID NO: 148 | BIRC3 | 11 | 102188194 | 102208448 | 1 | 00000023445 |
| 00000285274 SEQ ID NO: 149 | FOXO3B | 17 | 18565250 | 18585572 | -1 | 00000213688 |
| 00000288221 SEQ ID NO: 150 | ERC2 | 3 | 55542336 | 56502391 | -1 | 00000187672 |
| 00000302102 SEQ ID NO: 151 | ATP1A3 | 19 | 42470734 | 42498379 | -1 | 00000105409 |
| 00000303115 SEQ ID NO: 152 | IL7R | 5 | 35857000 | 35879705 | 1 | 00000168685 |
| 00000306317 SEQ ID NO: 153 | LGI3 | 8 | 22004338 | 22014345 | -1 | 00000168481 |
| 00000309384 SEQ ID NO: 154 | KLRC4 | 12 | 10559983 | 10562356 | -1 | 00000183542 |
| 00000311854 + 00000380781 SEQ ID NO: 155 | NEFL | 8 | 24808480 | 24814131 | -1 | 00000104725 |
| 00000315947 SEQ ID NO: 156 | OR4N2 | 14 | 20295608 | 20296531 | 1 | 00000176294 |
| 00000327305 SEQ ID NO: 157 | NETO1 | 18 | 70409671 | 70535184 | -1 | 00000166342 |
| 00000333447 SEQ ID NO: 158 | PPFIA2 | 12 | 81653356 | 81851648 | -1 | 00000139220 |
| 00000350485 SEQ ID NO: 159 | TAC1 | 7 | 97361396 | 97369750 | 1 | 00000006128 |
| 00000356921 + 00000358407 + 00000381269 SEQ ID NO: 160 | SLC8A3 | 14 | 70510934 | 70655787 | -1 | 00000100678 |
| 00000367397 SEQ ID NO: 161 | CRB1 | 1 | 197382959 | 197413949 | 1 | 00000134376 |
| 00000367733 SEQ ID NO: 162 | DNM3 | 1 | 171810638 | 172102530 | 1 | 00000197959 |
| 00000370056 SEQ ID NO: 163 | VAV3 | 1 | 108113782 | 108507585 | -1 | 00000134215 |
| 00000371194 SEQ ID NO: 164 | AL590244.1 | 6 | 49518388 | 49529620 | 1 | 00000197261 |
| 00000373970 SEQ ID NO: 165 | DKK1 | 10 | 54074056 | 54077417 | 1 | 00000107984 |
| 00000374848 SEQ ID NO: 166 | C9orf125 | 9 | 104235453 | 104249475 | -1 | 00000165152 |
| 00000377899 SEQ ID NO: 167 | PCSK2 | 20 | 17206752 | 17465223 | 1 | 00000125851 |
| 00000378122 SEQ ID NO: 168 | PCDHA9 | 5 | 140227357 | 140233515 | 1 | 00000204961 |
| 00000381055 SEQ ID NO: 169 | ADAMTS6 | 5 | 64444570 | 64777747 | -1 | 00000049192 |
| 00000381902 SEQ ID NO: 170 | KLRC2 | 12 | 10583210 | 10588592 | -1 | 00000205809 |
| 00000381904 SEQ ID NO: 171 | KLRC3 | 12 | 10564921 | 10573194 | -1 | 00000205810 |
| 00000389125 SEQ ID NO: 172 | GRIK1 | 21 | 30909254 | 31311943 | -1 | 00000171189 |
| 00000390237 SEQ ID NO: 173 | IGKC | 2 | 89156674 | 89157196 | -1 | 00000211592 |
| 00000390329 + 00000424688 SEQ ID NO: 174 | D87017.2 | 22 | 23261707 | 23262030 | 1 | 00000211683 |

TABLE 1-continued

| ENSEMBL ENST# TRANSCRIPT ID/ (SEQ ID NO:) | GENE NAME or SYMBOL | CHROMOSOME # | NUCL. BASE START | NUCL BASE END | STRAND | ENSEMBL GENE ID (ENSG#) |
|---|---|---|---|---|---|---|
| 00000390543 SEQ ID NO: 175 | IGHG4 | 14 | 106090687 | 106092403 | −1 | 00000211892 |
| 00000390545 SEQ ID NO: 176 | IGHG2 | 14 | 106109389 | 106111127 | −1 | 00000211893 |
| 00000390547 SEQ ID NO: 177 | IGHA1 | 14 | 106173457 | 106175002 | −1 | 00000211895 |
| 00000390549 SEQ ID NO: 178 | IGHM | 14 | 106207675 | 106209408 | −1 | 00000211896 |
| 00000393296 SEQ ID NO: 179 | SYT6 | 1 | 114631914 | 114696472 | −1 | 00000134207 |
| 00000398769 SEQ ID NO: 180 | AC008013.2 | 12 | 31265170 | 31272406 | −1 | 00000177359 |
| 00000400677 SEQ ID NO: 181 | HMX1 | 4 | 8868773 | 8873543 | −1 | 00000215612 |
| 00000406397 SEQ ID NO: 182 | VSNL1 | 2 | 17722427 | 17838285 | 1 | 00000163032 |
| 00000409748 SEQ ID NO: 183 | CNTNAP5 | 2 | 124782864 | 125672912 | 1 | 00000155052 |
| 00000411758 SEQ ID NO: 184 | AC008088.2 | 17 | 20294965 | 20319997 | 1 | 00000154898 |
| 00000413687 SEQ ID NO: 185 | C1orf106 | 1 | 200863999 | 200884863 | 1 | 00000163362 |
| 00000418923 SEQ ID NO: 186 | RP11-347N5 | 13 | 102945286 | 103054799 | −1 | 00000243319 |
| 00000421686 SEQ ID NO: 187 | RP11-146D12 | 9 | 42410363 | 42474269 | 1 | 00000240240 |
| 00000425271 SEQ ID NO: 188 | AL390115.1 | 1 | 166304121 | 166304999 | 1 | 00000229588 |
| 00000425633 SEQ ID NO: 189 | NCRNA00032 | 9 | 27245682 | 27282791 | −1 | 00000231459 |
| 00000425669 SEQ ID NO: 190 | AL450364.1 | 10 | 18802044 | 18834580 | −1 | 00000240291 |
| 00000427239 SEQ ID NO: 191 | COL11A1 | 1 | 103474029 | 103573734 | −1 | 00000060718 |
| 00000433011 SEQ ID NO: 192 | CXorf35 | X | 100673275 | 100788446 | 1 | 00000196440 |
| 00000434347 SEQ ID NO: 193 | SH3GL3 | 15 | 84159586 | 84287491 | 1 | 00000140600 |
| 00000436075 SEQ ID NO: 194 | AC007731.3 | 22 | 20837102 | 20838392 | −1 | 00000236670 |
| 00000437534 SEQ ID NO: 195 | CKMT1B | 15 | 43886225 | 43891604 | 1 | 00000237289 |
| 00000438418 SEQ ID NO: 196 | AC105765.2 | 3 | 18504392 | 18505831 | 1 | 00000228956 |
| 00000439543 SEQ ID NO: 197 | EMG1 | 12 | 7080087 | 7095921 | 1 | 00000126749 |
| 00000440363 SEQ ID NO: 198 | AF165176.1 | 21 | 41990433 | 42002693 | −1 | 00000233756 |
| 00000441231 SEQ ID NO: 199 | AL021406.1 | 20 | 8229351 | 8230389 | 1 | 00000225479 |
| 00000441301 SEQ ID NO: 200 | F13A1 | 6 | 6144311 | 6321128 | −1 | 00000124491 |
| 00000442176 SEQ ID NO: 201 | AC005550.1 | 7 | 15728003 | 15735116 | 1 | 00000229108 |
| 00000446737 SEQ ID NO: 202 | PAK3 | X | 110187513 | 110464146 | 1 | 00000077264 |
| 00000450146 SEQ ID NO: 203 | ERBB3 | 12 | 56492491 | 56497128 | 1 | 00000065361 |
| 00000454036 SEQ ID NO: 204 | SLC12A5 | 20 | 44650329 | 44688789 | 1 | 00000124140 |
| 00000457776 SEQ ID NO: 205 | RP11-423O2 | 1 | 142803532 | 142827235 | 1 | 00000232745 |
| 00000460438 SEQ ID NO: 206 | ETV1 | 7 | 13998382 | 14028728 | −1 | 00000006468 |
| 00000461801 SEQ ID NO: 207 | FXR1 | 3 | 180650824 | 180652984 | 1 | 00000114416 |
| 00000462598 SEQ ID NO: 208 | FYN | 6 | 112035550 | 112115053 | −1 | 00000010810 |
| 00000463645 SEQ ID NO: 209 | C2orf27A | 2 | 132491229 | 132509242 | 1 | 00000197927 |
| 00000464572 SEQ ID NO: 210 | FAM48A | 13 | 37612172 | 37633776 | −1 | 00000102710 |
| 00000466541 SEQ ID NO: 211 | SHROOM3 | 4 | 77357299 | 77480729 | 1 | 00000138771 |

TABLE 1-continued

| ENSEMBL ENST# TRANSCRIPT ID/ (SEQ ID NO:) | GENE NAME or SYMBOL | CHRO-MOSOME # | NUCL. BASE START | NUCL BASE END | STRAND | ENSEMBL GENE ID (ENSG#) |
|---|---|---|---|---|---|---|
| 00000468813 SEQ ID NO: 212 | CREB5 | 7 | 28763917 | 28766348 | 1 | 00000146592 |
| 00000470802 SEQ ID NO: 213 | ROBO2 | 3 | 77678273 | 77698651 | 1 | 00000185008 |
| 00000471090 SEQ ID NO: 214 | RP11-706O15 | X | 3735576 | 3742639 | −1 | 00000205664 |
| 00000473185 SEQ ID NO: 215 | CHI3L1 | 1 | 203148059 | 203151262 | −1 | 00000133048 |
| 00000473361 SEQ ID NO: 216 | SPOCD1 | 1 | 32256029 | 32264216 | −1 | 00000134668 |
| 00000473640 SEQ ID NO: 217 | ASTN1 | 1 | 176945189 | 177001686 | −1 | 00000152092 |
| 00000475285 SEQ ID NO: 218 | SLIT1 | 10 | 98912808 | 98924646 | −1 | 00000187122 |
| 00000475659 SEQ ID NO: 219 | CRB1 | 1 | 197237406 | 197327258 | 1 | 00000134376 |
| 00000478136 SEQ ID NO: 220 | FAM19A1 | 3 | 68053359 | 68594776 | 1 | 00000183662 |
| 00000478803 SEQ ID NO: 221 | PLA2G5 | 1 | 20396788 | 20417321 | 1 | 00000127472 |
| 00000479198 SEQ ID NO: 222 | SYNPR | 3 | 63429004 | 63602597 | 1 | 00000163630 |
| 00000480144 SEQ ID NO: 223 | SLTM | 15 | 59190181 | 59225799 | −1 | 00000137776 |
| 00000482437 SEQ ID NO: 224 | CCDC76 | 1 | 100598721 | 100610123 | 1 | 00000122435 |
| 00000486152 SEQ ID NO: 225 | ZBTB20 | 3 | 114106122 | 114219238 | −1 | 00000181722 |
| 00000490066 SEQ ID NO: 226 | SLC16A9 | 10 | 61443856 | 61469280 | −1 | 00000165449 |
| 00000490795 SEQ ID NO: 227 | PRKD1 | 14 | 30060321 | 30066874 | −1 | 00000184304 |
| 00000494864 SEQ ID NO: 228 | CYP1B1 | 2 | 38297209 | 38337044 | −1 | 00000138061 |
| 00000498168 SEQ ID NO: 229 | EXOSC7 | 3 | 45018584 | 45030734 | 1 | 00000075914 |
| 00000498203 SEQ ID NO: 230 | SPAG4 | 20 | 34205611 | 34208856 | 1 | 00000061656 |
| 00000498435 SEQ ID NO: 231 | AC110080.11 | 2 | 89512908 | 89513413 | −1 | 00000244575 |

By "classifier" or "signature" is meant the combination of target isoform transcripts useful to diagnose or predict the GBM subtype of disease in a tested patient or subject biological sample. For example, the 121 target isoform transcripts of Table 1 can be one signature (e.g., as used in the process disclosed in FIG. 8). Alternatively the 214 target isoform transcripts identified in total in Table 1 can be a classifier in a similar process. In another embodiment, some selection of target isoforms from Table 1 that are more than 121 but less than 214 may be used as the classifier. In still further embodiments, small numbers of target isoforms selected from the 214 or 121 of Table 1 may also be used as classifiers according to the methods and compositions described herein. In the context of the compositions and methods described herein, reference to "at least two," "at least five," at least 121" etc. of the isoform targets listed in any particular classifier set means any and all combinations of the target isoforms identified. Specific target isoforms for the isoform signature or classifier do not have to be in rank order as set out in Table 1.

The term "RNA-based assay" is intended to include, without limitation, assays such as RNA-seq or mRNA-seq assay by NextGen sequencing of RNA, or a customized microarray panel consisting of e.g., the 214 total transcripts or 121 "signature" transcripts of Table 1, or some combination thereof, plus controls, presented on e.g., AFFYME-TRIX exon-array; AGILENT microarray; ILLUMINE micro-array, also a NONOSTRING assay, ILLUMINA HISEQ assay or RT-qPCR based assay to measure the abundance of these isoform or gene transcripts. In one embodiment, RNA based assays are preferred for use in the methods described herein.

The methods and compositions described herein can, in principle, be translatable to known protein-based assays and ligands that bind proteins or peptides. However, as will be clear to one of skill in the art, if protein assays are used, such assays will not be useful for certain isoform transcripts in the classifiers that are non-coding (function as RNA and do not translate to protein).

By "significant change in expression" is meant an upregulation in the expression level of a nucleic acid sequence, e.g., genes or isoform, in comparison to the selected reference standard or control; a downregulation in the expression level of a nucleic acid sequence, e.g., genes or isoform transcript in comparison to the selected reference standard or control; or a combination of a pattern or relative pattern of certain upregulated and/or down regulated isoforms. The degree of change in isoform expression can vary with each individual.

The term "polynucleotide," when used in singular or plural form, generally refers to any polyribonucleotide or polydeoxyribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The term "polynucleotide" specifically includes cDNAs. The term includes DNAs (including cDNAs) and RNAs that contain one or more modified bases. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide of less than 20 bases, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

"Reference standard" as used herein refers to the source of the reference target isoform or gene levels. The "reference standard" is preferably provided by using the same assay technique as is used for measurement of the subject's target isoform levels in the reference subject or population, to avoid any error in standardization. The reference standard is, alternatively, a numerical value, a predetermined cutpoint, a mean, an average, a numerical mean or range of numerical means, a numerical pattern, a ratio, a graphical pattern or a gene signature profile or gene level profile derived from the same target isoform or target isoforms in a reference subject or reference population.

"Reference subject" or "Reference Population" defines the source of the reference standard. In one embodiment, the reference is a human subject or a population of subjects having no cancer, i.e., healthy controls or negative controls. In yet another embodiment, the reference is a human subject or population of subjects with one or more clinical indicators of GBM, but who did not develop GBM. In still another embodiment, the reference is a human subject or a population of subjects having benign brain nodules or cysts. In still another embodiment, the reference is a human subject or a population of subjects who had GBM, following surgical removal of a GBM tumor. In another embodiment, the reference is a human subject or a population of subjects who had GBM and was evaluated for target isoform levels prior to surgical removal of a GBM tumor. Similarly, in another embodiment, the reference is a human subject or a population of subjects evaluated for target isoform levels following therapeutic treatment for GBM. In still another embodiment, the reference is a human subject or a population of subjects prior to therapeutic treatment for an GBM. In still other embodiments of methods described herein, the reference is obtained from the same test subject who provided a temporally earlier biological sample. That sample can be pre- or post-therapy or pre- or post-surgery.

Other potential reference standards are obtained from a reference that is a human subject or a population of subjects having early stage or late stage GBM or one of the four identified subtypes. In another embodiment, the reference standard is a combination of two or more of the above reference standards.

Selection of the particular class of reference standards, reference population, target isoform levels or profiles depends upon the use to which the diagnostic/monitoring methods and compositions are to be put by the physician and the desired result, e.g., initial diagnosis of GBM, subtype identification, or other GBM condition, clinical management of patients with GBM after initial diagnosis, including, but not limited to, monitoring for reoccurrence of disease or monitoring remission or progression of the cancer and either before, during or after therapeutic or surgical intervention, selecting among therapeutic protocols for individual patients, monitoring for development of toxicity or other complications of therapy, predicting development of therapeutic resistance, and the like. Such reference standards or controls are the types that are commonly used in similar diagnostic assays for other target isoforms.

"Sample" as used herein means any biological fluid or tissue that contains the GBM cancer target isoforms identified herein. In one embodiment, the sample is GBM tumor tissue or biopsy. In one embodiment, the sample is cerebrospinal fluid or a tumor secretome. Other samples for use in the methods and with the compositions are samples which require minimal invasion for testing include, e.g., blood samples, including serum, plasma, whole blood, and circulating tumor cells, cerebrospinal fluid, ascites fluid, tumor secretome fluid, peritoneal fluid, and RNA isolated therefrom.

It is also anticipated that other biological fluids, such as saliva or urine, and ascites fluids or peritoneal fluid may be similarly evaluated by the methods described herein. Also, circulating tumor cells or fluids containing them are also suitable samples for evaluation in certain embodiments of this invention. Such samples may further be diluted with saline, buffer or a physiologically acceptable diluent. Alternatively, such samples are concentrated by conventional means. The samples may be prepared for analysis by the methods described herein by isolation of RNA from the sample.

The term "ligand" refers with regard target isoforms to a molecule that binds or complexes, or hybridizes with an isoform nucleotide sequence, e.g., polynucleotide or oligonucleotide, primers or probes. Only if a protein assay is employed as discussed above, would the ligand be of the type that would bind or complex to a protein expression product of the isoform, if any existed.

As used herein, "labels" or "reporter molecules" are chemical or biochemical moieties useful for labeling a ligand. "Labels" and "reporter molecules" include fluorescent agents, chemiluminescent agents, chromogenic agents, quenching agents, radionucleotides, enzymes, substrates, cofactors, inhibitors, radioactive isotopes, magnetic particles, and other moieties known in the art. "Labels" or "reporter molecules" are capable of generating a measurable signal and may be covalently or noncovalently joined to a ligand.

It should be understood that while various embodiments in the specification are presented using "comprising" language, under various circumstances, a related embodiment is also be described using "consisting of" or "consisting essentially of" as language. It is to be noted that the term "a" or "an", refers to one or more, for example, "a gene transcript," is understood to represent one or more gene transcripts. As such, the terms "a" (or "an"), "one or more," and "at least one" is used interchangeably herein.

Unless defined otherwise in this specification, technical and scientific terms used herein have the same meaning as commonly understood by one of ordinary skill in the art to which this invention belongs and by reference to published texts, which provide one skilled in the art with a general guide to many of the terms used in the present application.

II. DIAGNOSTIC REAGENTS, DEVICES AND KITS

In one aspect, an isoform-level gene panel is provided that can accurately classify a glioblastoma subtype as Proneural (PN), Neural (N), Mesenchymal (M) or Classical (C) from a tumor sample comprises a group of target isoforms selected from those identified in Table 1. As disclosed in the examples below, use of the methods and assays described herein with these new isoform-level signatures permits refining of the four known subtype classifications. The refinement involves re-assigning some patient samples to a different sub-group (see Table 4), leading to a better prognostic stratification (see FIG. 2C). In one embodiment, the isoform gene panel contains the 121 isoform targets of Table 1. In another embodiment, the isoform gene panel contains all 214 isoform targets of Table 1. These isoform panels may be immobilized on a substrate, wherein the substrate is a microarray, a microfluidics card, a chip, a bead, or a chamber.

In another aspect, a kit, panel or microarray is provided comprising multiple ligands, each ligand capable of specifically complexing with, binding to, hybridizing to, or quantitatively detecting or identifying a single target isoform. In one embodiment, the total number of isoform targets, and thus ligands, in a kit are selected from the 121 target isoforms of Table 1, the 214 target isoforms of Table 1, or some combination thereof. In another embodiment, a kit, panel or microarray can include suitable labeled or immobilized ligands in a number of at least 50, 100, 121, 150, 200 or 214 of the isoform targets of Table 1. In still another embodiment at least one ligand of the kit, panel or microarray is associated with a detectable label or with a substrate. In another embodiment, each ligand identifies the level of expression or activity of a different target isoform of Table 1. In still further embodiment, the kit, panel or microarray described herein comprises ligands that individually bind to or complex or hybridize and identify the level of expression or activity of all 121 target isoforms identified in the top of Table 1 or all 214 isoform targets including those identified at the lower portion of Table 1.

Still additional kits, panels or microarrays described herein contain other ligands or reagents that identify the level of expression or activity of the controls that are upregulated in GBM relative to a normal reference standard. In another embodiment, the kit, panel or microarray comprises ligands or reagents that identify the level of expression or activity of the controls that are downregulated in GBM relative to a normal reference standard. In still a further embodiment, the kit, panel or microarray comprises ligands or reagents that identify the level of expression or activity of endogenous controls or housekeeping genes, such as those identified in Table 1.

As discussed above, the kit, panel or microarray is designed, wherein each ligand is selected from a nucleotide or oligonucleotide sequence that binds to or complexes or hybridizes with a single isoform target of Table 1. For example, such ligand directed to a single isoform target is a PCR oligonucleotide primer or probe, or a pair of PCR oligonucleotide primers or probes. Such sequences bind to or complex or hybridize with a single isoform target of Table 1. Such a polynucleotide/oligonucleotide probe or primer may itself be labeled or immobilized. In one embodiment, ligand-hybridizing polynucleotide or oligonucleotide reagent(s) are part of a primer-probe set, and the kit comprises both primer and probe. Each the primer-probe set amplifies a different target isoform of Table 1, optionally including the control isoforms and housekeeping genes.

For use in the compositions the PCR primers and probes are preferably designed based upon the isoform sequences present in Table 1. The design of the primer and probe sequences is within the skill of the art based on selection of each isoform target. The particular methods selected for the primer and probe design and the particular primer and probe sequences are not limiting features of these compositions. A ready explanation of primer and probe design techniques available to those of skill in the art is summarized in U.S. Pat. No. 7,081,340, with reference to publically available tools such as DNA BLAST software, the REPEAT MASKER program (Baylor College of Medicine), Primer Express (Applied Biosystems); MGB assay-by-design (Applied Biosystems); Primer3 (Steve Rozen and Helen J. Skaletsky (2000) Primer3 on the WWW for general users and for biologist programmers and other publications.

In general, optimal PCR primers and probes used in the compositions described herein are generally 17-30 bases in length, and contain about 20-80%, such as, for example, about 50-60% G+C bases. Melting temperatures of between 50 and 80° C., e.g. about 50 to 70° C. are typically preferred.

The kits, panels or microarrays may further include labels selected from among many known diagnostic labels, including those described above. Similarly, the substrates for immobilization of one or more, or all of the isoform targets or may be any of the common substrates, glass, plastic, a microarray, a microfluidics card, a chip, a bead or a chamber. In another embodiment, the kit also contains optional substrates for enzymatic labels, as well as other laboratory items.

Still further components of the kit, panel or microarray as described herein can include other known reagents and components for conducting an RNA-based assay, including RNA-seq or mRNA-seq assay by NextGen sequencing of RNA, or a customized microarray panel consisting of e.g., the 214 total transcripts or 121 "signature" transcripts of Table 1, or some combination thereof, plus controls, presented on e.g., AFFYMETRIX exon-array; AGILENT microarray; ILLUMINE microarray, also a NONOSTRING assay, ILLUMINA HISEQ assay. In the exemplified embodiment of the examples, an RT-qPCR based assay was employed to identify and/or measure the levels of these isoform or gene transcripts in a sample.

Any combination of labeled or immobilized target isoform ligands can be assembled in a diagnostic kit or device for the purposes of diagnosing brain cancer, brain tumor or a glioblastoma or subtype thereof.

As still a further embodiment, the kit, panel or microarray further comprising computer software that performs the functions outline in FIG. 8 and as discussed below.

The selection of the ligands, groups of target isoforms and sequences, their length, suitable labels and substrates used in the reagents and kits are routine determinations made by one of skill in the art in view of the teachings herein of which target isoforms form signatures suitable for the diagnosis of brain cancer, brain tumor or a glioblastoma.

Figure 7:
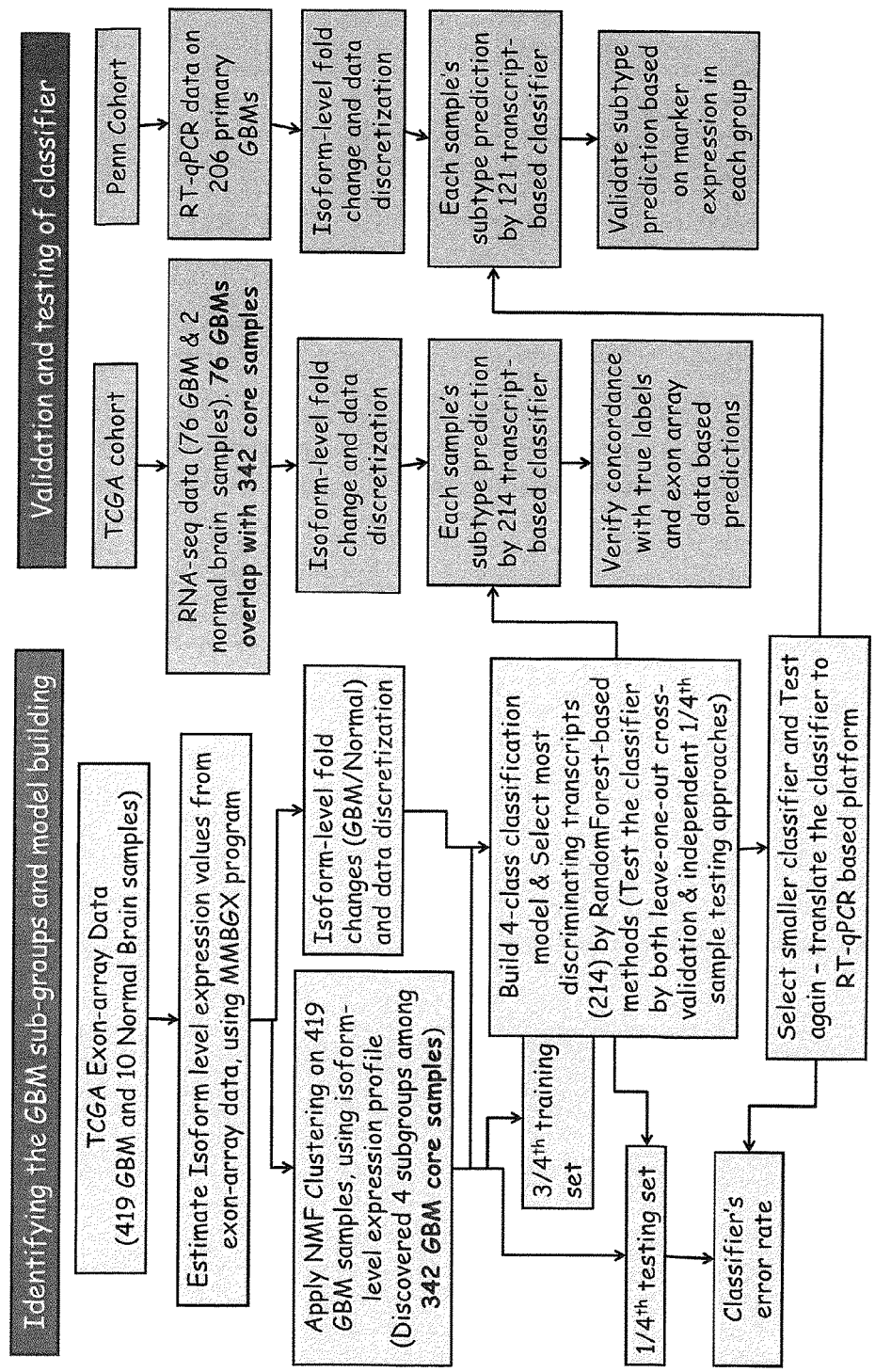
FIG. 7 is a flow-chart illustrating the process of identifying the GBM sub-groups and building the model for selecting and generating the classifier and transitioning to RT-PCR and RNA-sequence platforms. Also shown in the process for validating and testing of the classifier

The selection and validation of the target isoforms for use in these diagnostic reagents and kits are summarized in detail in FIG. 7.

III. METHODS FOR DIAGNOSING OR MONITORING BRAIN CANCER, BRAIN TUMOR OR A GLIOBLASTOMA OR SUBTYPE THEREOF

In another embodiment, a method for diagnosing or detecting, predicting the subtype, or monitoring the progress of brain cancer, brain tumor or a glioblastoma in a subject comprises, or consists of, a variety of steps. These steps are also summarized with the necessary algorithms in FIG. 8. This method may employ any of the suitable diagnostic reagents or kits or compositions described above.

The test sample is obtained from a human subject who is to undergo the testing or treatment. The subject's sample can in one embodiment be provided before initial diagnosis, so that the method is performed to diagnose the existence of a brain cancer, brain tumor or a glioblastoma. In another embodiment, depending upon the reference standard and target isoforms used, the method is performed to diagnose the subtype or brain cancer, brain tumor or a glioblastoma. In another embodiment, depending upon the reference standard and markers used, the method is performed to diagnose the stage of brain cancer, brain tumor or a glioblastoma. In another embodiment, the subject's sample can be provided after a diagnosis, so that the method is performed to monitor progression of n brain cancer, brain tumor or a glioblastoma. In another embodiment, the sample can be provided prior to surgical removal of a tumor or prior to therapeutic treatment of a diagnosed brain cancer, brain tumor or a glioblastoma and the method used to thereafter monitor the effect of the treatment or surgery, and to check for relapse. In another embodiment, the sample can be provided following surgical removal of a tumor or following therapeutic treatment of a diagnosed brain cancer, brain tumor or a glioblastoma, and the method performed to ascertain efficacy of treatment or relapse. In yet another embodiment the sample may be obtained from the subject periodically during therapeutic treatment for a brain cancer, brain tumor or a glioblastoma, and the method employed to track efficacy of therapy or relapse. In yet another embodiment the sample may be obtained from the subject periodically during therapeutic treatment to enable the physician to change therapies or adjust dosages. In one or more of these embodiments, the subject's own prior sample can be employed in the method as the reference standard.

Where the sample is a fluid, e.g., cerebrospinal fluid, blood, serum or plasma, obtaining the sample involves simply withdrawing and preparing the sample for isolation of RNA therefrom in the traditional fashion for use in the methods. Where the sample is a tissue or tumor or biopsy sample, it may be prepared as described in the examples below for isolation of RNA therefrom, or any conventional manner prior to performance of the assay.

The isoform-level assay for diagnosis of brain cancer, e.g., for prediction or diagnosis of the molecular subtype of a glioblastoma multiforme, in a subject thus comprises the following steps. One embodiment of the method, as well as the function of the computer program and its algorithms is outlined in FIG. 8.

The biological sample obtained from a subject that has or is suspected of having a glioblastoma is contacted with an isoform panel having target isoforms selected from Table 1, or a combination thereof, or a reagent, kit, panel or microarray of ligands capable of specifically complexing with, binding to, or quantitatively detecting or identifying the level or activity of target isoforms of Table 1 or a combination thereof. In one embodiment, such contact occurs in the performance of an RNA-based assay, such as RT-qPCR assay or an ILLUMINA HISEQ assay.

Other commonly used methods known in the art for the quantification of mRNA expression in a sample include northern blotting and in situ hybridization; RNAse protection assays; and PCR-based methods, such as reverse transcription polymerase chain reaction (RT-PCR) or qPCR. The methods described herein are not limited by the particular techniques selected to perform them. Exemplary commercial products for generation of reagents or performance of assays include TRI-REAGENT, Qiagen RNeasy mini-columns, MASTERPURE Complete DNA and RNA Purification Kit (EPICENTRE®, Madison, Wis.), Paraffin Block RNA Isolation Kit (Ambion, Inc.) and RNA Stat-60 (Tel-Test), the MassARRAY-based method (Sequenom, Inc., San Diego, Calif.), differential display, amplified fragment length polymorphism (iAFLP), and BeadArray™ technology (Illumina, San Diego, Calif.) using the commercially available Luminex100 LabMAP system and multiple color-coded microspheres (Luminex Corp., Austin, Tex.) and high coverage expression profiling (HiCEP) analysis.

As described in the examples below and summarized in FIG. 8, the PCR assays involves contact of the sample with 121 isoform transcripts of Table 1, 15 control transcripts and 4 housekeeping genes. The individual levels or activities of the target isoforms relative to a reference standard, e.g., normal population with no cancer, are then determined in the RNA sequence based protocol. Thereafter the results of the RNA based assay are analyzed in a computer program performing the functions as described in FIG. 8. The program generates an isoform signature that permits a diagnosis or prediction of the subject's GBM molecular subtype.

The PCR cycle value of each isoform target transcript is obtained and manipulated by the algorithm $Ct_{transcript\ 1} - Ct_{Polr2A} = DelCt_{GBM}$ (which is the DelCt of the patient sample). Then the $\log_2$ Foldchange between the patient's value and normal is calculated using $DelCt_{normal}$, which was the DelCt values for normal brain obtained using 136 transcripts/genes as described in more detail in the examples. DelCt is used in calculation of fold change based on qPCR output which is Ct value when we perform relative quantification. DelCt is defined as the difference between the Ct value of a given transcript/isoform (one of the 214/121 transcripts or control 15 transcripts) and the Ct value of the normalization control gene, which in our case is Polr2a in the same samples. This value is then added to the PCR data matrix which was generated for 206 GBM patients as described in the examples below. The fold change is then discretized with 20 bins and the classifier, e.g., the 121 signature target isoform transcripts based panel or the 215 target isoform transcript panel, is applied on the discretized data.

Thereafter the predicted subtype of the sample based on maxP is obtained. This protocol is defined more specifically in the examples below.

In one embodiment, the assay includes in the PCR step, the ligands directed to the controls identified in Table 1. In another embodiment, the ligands are those capable of specifically complexing with, binding to, or quantitatively detecting or identifying the level or activity of all 121 signature target isoforms identified in the top portion of Table 1 and the controls identified in Table 1. In another embodiment, the ligands used in the PCR are those directed to all 214 isoform targets of Table 1. In still another embodiment, the ligands used in the method are a combination of those generated to isoform targets selected from the 214 isoform targets of Table 1.

For the performance of the PCR portion of the method, the reference standard is a mean, an average, a numerical mean or range of numerical means, a numerical pattern, a ratio, a graphical pattern or a protein level profile derived from the same isoforms in a reference subject or reference population. For example, the reference standard is selected from a reference subject or reference population selected from the group consisting a reference human subject or a population of healthy with no glioblastoma multiforme (GBM); a reference human subject or a population of subjects having benign nodules; a reference human subject or a population of subjects following surgical removal of a GBM tumor; a reference human subject or a population of subjects prior to surgical removal of a GBM tumor; a reference human subject or a population of subjects following therapeutic treatment for a GBM tumor; a reference human subject or a population of subjects prior to therapeutic treatment for a GBM tumor; or the same subject who provided a temporally earlier biological sample.

In addition to making an initial clinical diagnosis of GBM or subtype of GBM, this method can be used to monitor relapse after initial diagnosis and treatment, predict clinical outcome or determine the best clinical treatment.

In yet another aspect, a modified method and algorithm for identifying classes of isoform level gene expression that are useful for identifying diseases or conditions is the Platform-independent Isoform-level Gene expression based classification system (PIGExClass).

The basic steps in PIGExClass algorithm are described below:

To derive numerically comparable measures of gene expression between different platforms, and translate the gene-panel (from the classifier) across platforms, we developed PIGExClass by combining a novel data-discretization[1] procedure with "variable selection" step, a randomForest-based variable selection algorithm[2]. The PIGExClass algorithm is available as a set of R scripts and reproduced in FIGS. 16A and 16B.

Step 1: Data-Discretization Step (Normalization Procedure for Cross Platform Transformation of Fold-Change Data):

We applied data discretization for converting continuous data values into categorical data (1). Basically, we discretized the fold-change levels (GBM over normal brain) of each transcript expression from each platform based on equal frequency or equal width binning (1) and converted the continuous fold change data to categorical values (FC-CVs—Fold Change Categorical Values), using the following procedure.

1. For each transcript/gene, sort the samples based on fold changes (FCs) in ascending order.

2. Divide sorted vector into a predetermined number of bins, so that the width of all bins is equal (equal-width binning) or the number of samples in each bin is equal (equal-frequency binning). The number of categories (bins) was determined whether finer or coarser discretization improves the accuracy of the classification model. Similarly, the choice between equal-frequency binning or equal-width binning was made depending on the accuracy of the derived classification model.

3. Each fold change value is replaced by an integer value corresponding to the rank of the bin it falls into.

Step 2: Variable Selection and Classification Steps:

Prior to building the classification model, we applied a randomForest-based variable selection algorithm (2) to select a small set of non-redundant genes or isoforms, using FCCVs. The variable selection was performed separately on gene-level or transcript-level fold changes. By selecting 213 transcripts/isoforms as the most discriminative variables between the four GBM subgroups, we created a randomForest classifier for subtype prediction (3,4). The cross-validation analysis of the final selected classifier was done by out-of-bag [OOB] approach. We further tested the classifier by dividing the isoform-based core samples into $3/4^{th}$ as training-set and $1/4^{th}$ as test-set. The classification model generated from the training set was applied to the test set.

RNA-seq data analysis: The TCGA GBM paired-end RNA-seq aligned barn files, for a total of 155 patient samples, were downloaded. A subset (76 datasets) of GBM samples have expression profiles from both RNA-seq and exon-array platforms. The RNA-seq barn files were converted to raw fastq files by Picard tools. The isoform level expression estimates were obtained by Tophat/Cufflinks pipeline using Ensembl 66 as reference (5) and expression estimates were normalized by upper quartile normalization. Two normal brain RNA-seq samples (used as controls to calculate expression fold-changes and FCCVs GBM over normal brain) were downloaded from SRA archive (ERR030882 and SRR309262) and analyzed using the same pipeline as the GBM samples.

Evaluation of the data-mining algorithm on RNA-seq data: We evaluated the transition of the PIGExClass from exon-array to an independent platform by applying the classifier (trained on exon-array data) on GBM RNA-seq samples. Misclassification rate was computed based on 76 GBM samples overlapped with the isoform-level core samples and profiled by both exon-array and RNA-seq methods. We have calculated the Pearson correlation between each pair of expression signatures (fold changes), before and after data discretization, for the 76 GBM samples that were profiled by both exon-array and RNA-seq platforms.

GBM Tissue Specimens: The GBM samples processed for RNA isolation were obtained from the Human Brain Tumor Tissue bank (HBTTB) at The University of Pennsylvania. Collection of brain tumor tissue was approved by the Hospital of the University of Pennsylvania Institutional Review Board, with wavier of informed consent for retrospective review of medical records. Procurement and processing of GBM tumor tissues from HBTTB was approved by the Wistar Institute's Institutional Review Board.

Open array design: To measure the expression of transcripts selected in the classifier we designed RT-qPCR assays to be performed on the high throughput OpenArray platform (Life Technologies Inc.). In one embodiment, the RandomForest algorithm discovered sets of isoforms that are discriminative between the 4 sub-groups of GBMs, as discussed in the examples below.

RNA isolation and RT-qPCR analysis: RNA was isolated using Tri Reagent (Sigma Inc.) and cDNA was synthesized using the high capacity cDNA reverse transcriptase kit (Applied Biosystems Inc.) according to manufacturer's instructions. Normal brain RNA was purchased from Agilent Inc.

Figure 8:
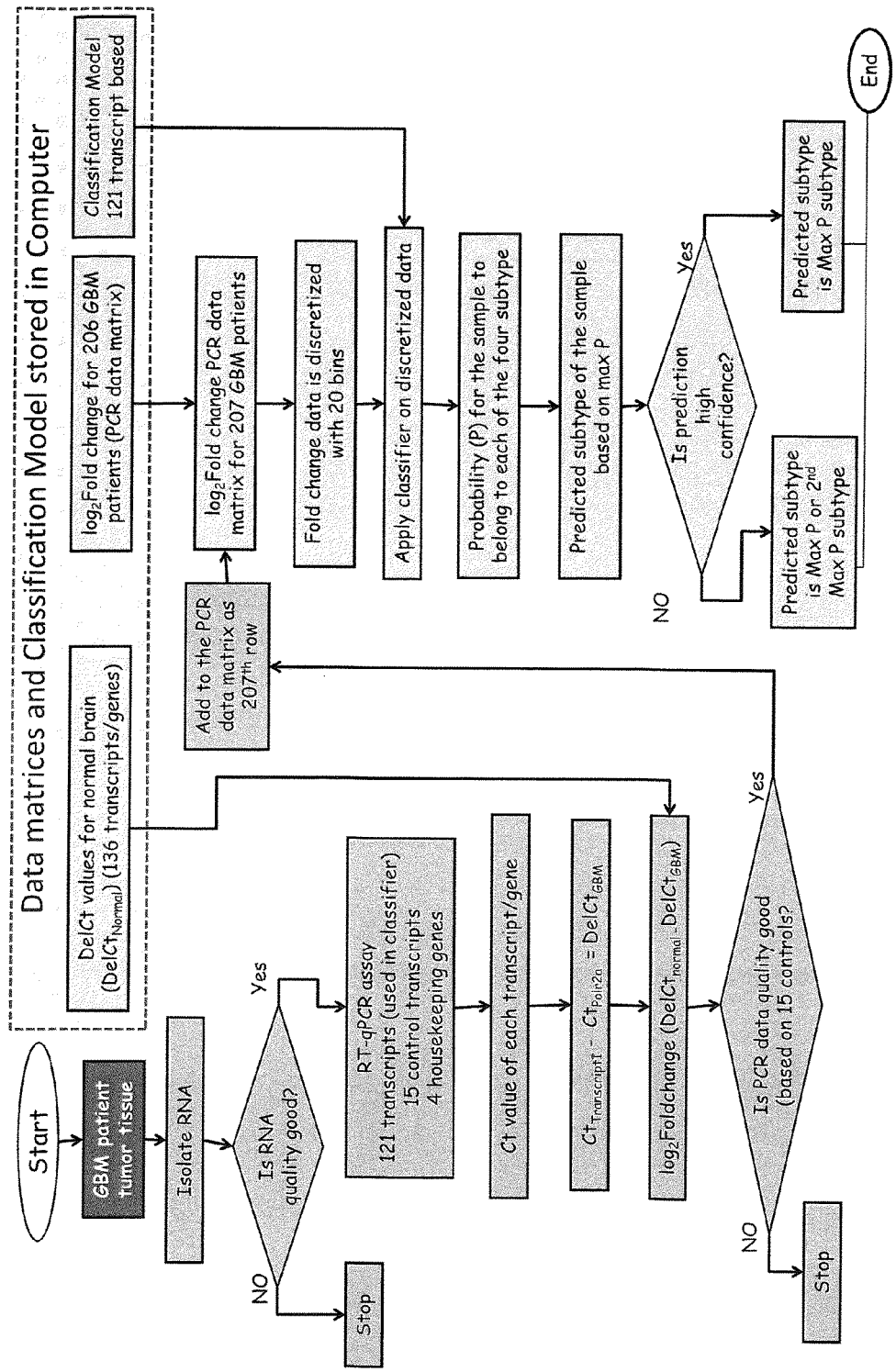
FIG. 8 is the flow chart illustrating the performance of the computer program that analyzes the data from the diagnostic assay using the 121 isoform assay described herein. Abbreviations used in the flow charts include: Polr2A, which is a gene used as a control on PCR assays; Ct, which is the cycle number obtained for a gene/transcript in a PCR assay; DelCt refers to Delta Ct value, a standard PCR measure. The PCR data-matrix is the data of 206 rows and 121 columns. Rows represent patients and columns represent Transcript IDs. Each entry in this matrix is a fold-change value (ratio of expression of a transcript in a patient sample over the expression of that transcript in normal brain) for the Xth transcript and Yth patient. The classifier is a RandomForest built model built from the original data matrix of the 342 TCGA GBM samples used in the process depicted in FIG. 7.
Figure 9:
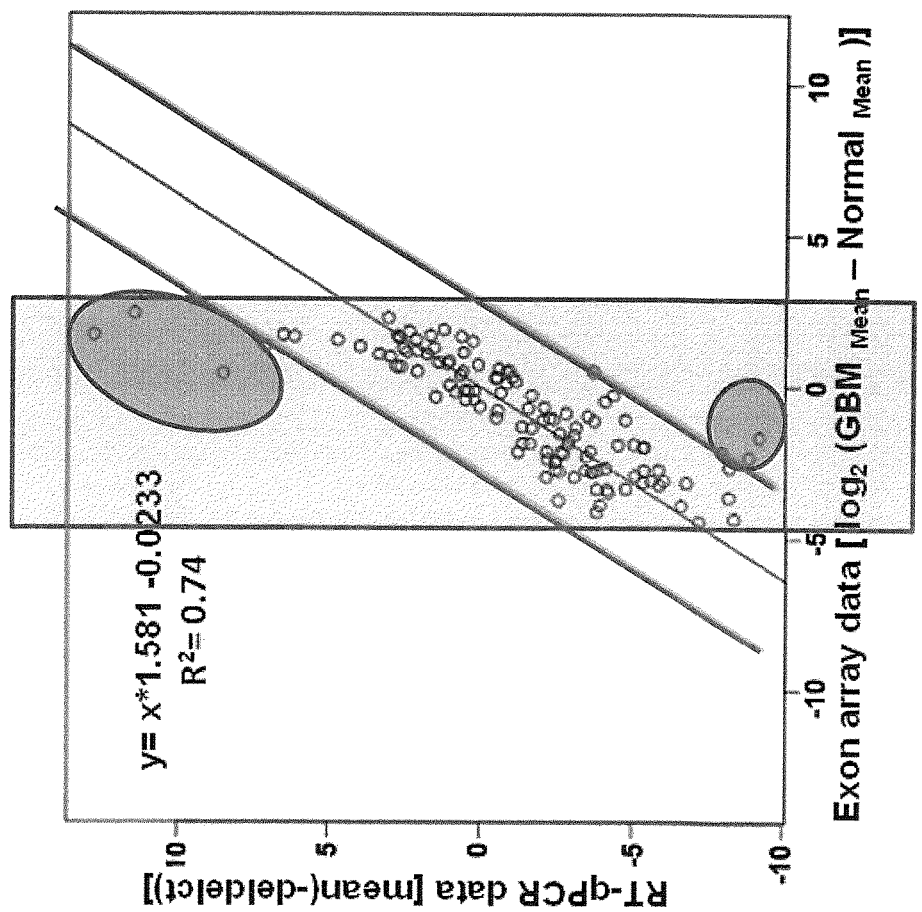
FIG. 9 is a graph showing Exon-array and RT-PCR correlations using the 121 isoform transcript classifier. Rt PCR data was linear transformed based on the equation in the graph.
Figure 10:
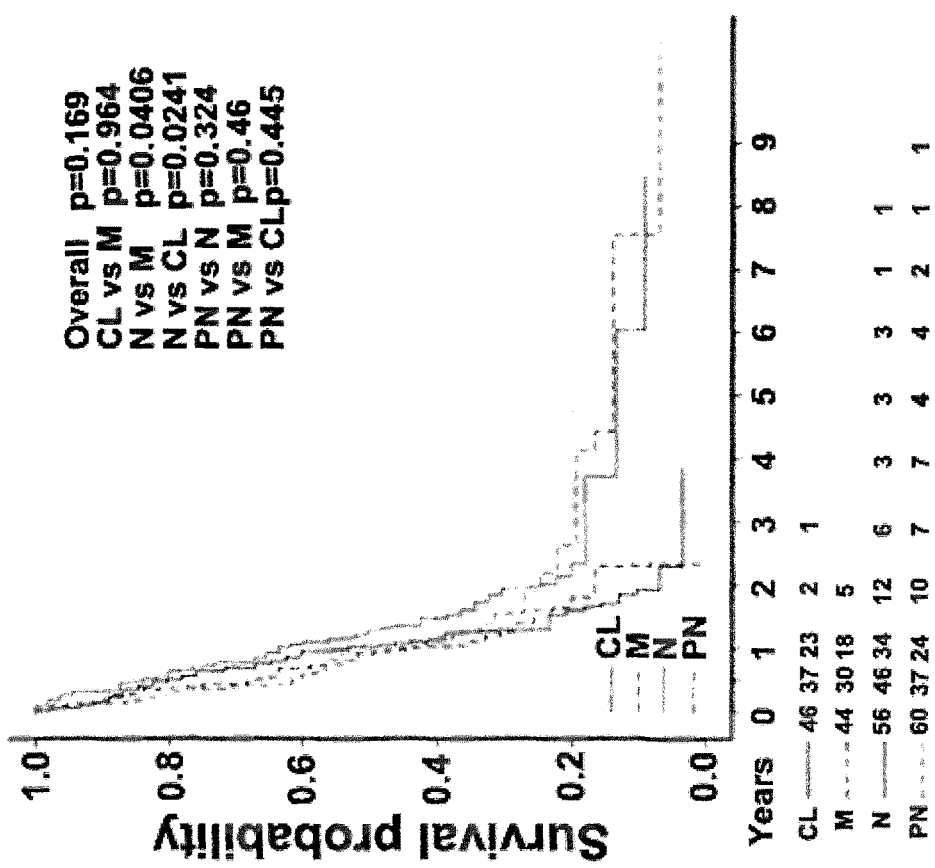
FIG. 10 is a graph showing survival curve for the four subtypes of GBM patients (Penn GBM cohort).

The method described herein can be performed at least partially by use of a properly programmed a computer processor or computer-programmed instrument that generates numerical or graphical data useful in the diagnosis of the condition using the functions and algorithms identified in FIG. 8.

In another aspect of the method, a computer program or source code that performs the functions and uses the algorithms of the flow chart of FIG. 8 is provided. It is anticipated that based on this disclosure, one of skill in the art may also generate similar or slightly modified programs that use the above-described diagnostic reagents and isoform transcript panels of Table 1 in a similar manner.

The results of the methods and use of the compositions described herein may be used in conjunction with clinical risk factors to help physicians make more accurate decisions about how to manage patients with brain cancer, brain tumor or a glioblastomas.

Thus, the various methods, devices and steps described above can be utilized in an initial diagnosis of brain cancer, brain tumor or a glioblastoma or other condition, as well as in clinical management of patients with brain cancer, brain tumor or a glioblastoma after initial diagnosis. Uses in clinical management of the various devices, reagents and assay methods, include without limitation, monitoring for reoccurrence of disease or monitoring remission or progression of the cancer and either before, during or after therapeutic or surgical intervention, selecting among therapeutic protocols for individual patients, monitoring for development of toxicity or other complications of therapy, and predicting development of therapeutic resistance.

As described and supported by the examples below, one major advantage of isoform-based subtyping of the TCGA primary GBM samples was in survival stratification. Unlike previous studies,[3,4,33] we found significantly better survival for the PN subgroup in the TCGA GBM cohort. Interestingly, we also observed that this survival advantage for the PN subgroup was relevant only for younger patients. Although isoform-based core samples of the TCGA cohort is much larger (342 samples) than the core group analyzed by the TCGA network,[3] this difference in the PN prognostic value between isoform- and gene-based classification is not due to unequal representation of younger patients in both studies (~16% patients <40 years in both studies). However, we did not observe a better survival rate for the PN group in the Penn cohort due to underrepresentation of younger patients. Strikingly, we observed better survival for the neural subtype, and most of the older patients who survive beyond three years belong to the PN or N subtypes in the Penn cohort. In comparison, the older and longer-surviving patients in the TCGA cohort were spread across the four subtypes, suggesting differences in the responses to surgery and chemotherapy/radiation therapies across the various tissue collection centers.

The prevalence of various mutations among the patients of the four subgroups defined by isoform-based clustering was analyzed (see Table 2 below). Though certain mutations tend to be associated with specific subtypes, only a fraction of primary GBM patients within each group harbor these mutations, indicating that mutational analysis is not an effective tool for accurately classifying GBM patients.

TABLE 2

Distribution of Frequently Mutated Genes across GBM Subtypes

| Gene | Proneural n = 31 | | Neural n = 36 | | Mesenchymal n = 34 | | Classical n = 17 | | Total # GBMs with Mutations | | |
|---|---|---|---|---|---|---|---|---|---|---|---|
| | ≤40Y 17 | >40Y 14 | ≤40Y 3 | >40Y 33 | ≤40Y 2 | >40Y 32 | ≤40Y 1 | >40Y 16 | ≤40Y 23 | >40Y 95 | Total 118 |
| TP53 | 8 20% | 6 15% | 2 5% | 8 15% | 2 5% | 12 30% | 1 3% | 1 3% | 13 | 27 | 40 |
| NF1 | 2 11% | 0 | 0 | 7 37% | 1 5% | 8 37% | 0 | 1 5% | 3 | 16 | 19 |
| EGFR | 2 11% | 1 5% | 1 5% | 9 47% | 0 | 1 5% | 1 5% | 4 21% | 4 | 15 | 19 |
| IDH1 | 6 60% | 2 20% | 2 20% | 0 | 0 | 0 | 0 | 0 | 8 | 2 | 10 |
| PIK3R1 | 5 50% | 1 10% | 0 | 3 30% | 0 | 0 | 0 | 1 10% | 5 | 5 | 10 |
| DST | 3 50% | 0 | 0 | 0 | 0 | 0 | 0 | 3 50% | 3 | 3 | 6 |
| ANK2 | 0 | 0 | 0 | 0 | 0 | 3 100% | 0 | 0 | 0 | 3 | 3 |
| CHEK1 | 0 | 0 | 0 | 0 | 0 | 0 | 0 | 2 100% | 0 | 2 | 2 |
| HSPA8 | 0 | 0 | 0 | 0 | 0 | 0 | 0 | 2 100% | 0 | 2 | 2 |

In agreement with the previous reports, NF1 mutations were found mostly in the M and N subtypes and EGFR mutations, including EGFRvIII, mostly in the CL and N subtypes. While only 8% of the TCGA GBM patients had an IDH1 mutation, 60% of the IDH1-mutated patients were of the PN subtype and younger than 40 years.

Interestingly, five out of six patients with the IDH1 mutation were from the MD Anderson center. The IDH1 mutation is a hallmark for low-grade gliomas and secondary GBMs that arise from low-grade gliomas.[38] Histologically, primary and secondary GBMs are similar in appearance,[29] and it is possible that GBMs with the IDH1 mutation, especially younger patients who have been clinically diagnosed with primary GBMs, could be, in fact, secondary GBMs that progressed from low-grade gliomas that escaped clinical diagnosis at early low-grade status.[39] This could be one possible explanation for the higher representation of young PN subtype patients in the TCGA GBM cohort who came mostly from the MD Anderson center. This speculation is further supported by the fact that secondary GBMs were classified as PN subtype in the TCGA network study.[3]

The compositions and methods described herein can be applied in ongoing clinical trials to determine recruited patients' subtypes for evaluating the subtype-specific efficacy of the drugs being tested.[46] The inventors discovered 2.6 times more changes at isoform-level than at the gene-level in the glioblastoma transcriptome. Using isoform-level expression clustering, four GBM subgroups were identified with significant (p=0.0103) survival differences. A four-class classifier, built with 121 transcript-variants, assigns GBM patients' molecular subtype with 92% accuracy. The GBM classifier was translated to an RT-qPCR-based assay and validated on an independent cohort of 206 glioblastoma samples, and maintained high-confidence subtype calls for 91% of the patients. We found the proneural subtype to have the worst prognosis for patients, except for the younger group (<40 years) who showed significantly better survival (p=0.007), while a better prognosis for the neural subtype was observed (p=0.02) in older patients (≥40 years). An isoform-level expression signature produced an accurate quantitative molecular diagnostic assay with improved prognostic stratification of GBM patients.

We considered that the isoform-level expression profiling generates better classification to identify the molecular sub-groups of GBM. To test this hypothesis, we performed isoform-level analysis of the exon array expression data for GBM patient samples from the TCGA data portal, and discovered that isoform-level analysis identifies 2.5 fold more differentially expressed transcript variants than differentially expressed genes captured by gene-level analysis, indicating that isoform-level expression profiling is more sensitive in identifying molecular changes among GBM patients. Next, we applied consensus non-negative matrix factorization (NMF) clustering method, based on isoform-level expression of most variable isoforms and effectively grouped the GBM samples into 4 sub-groups with significant (p=0.0103) survival differences between the groups. In contrast, though clustering based on gene-level expression produced four homogenous groups there was no significant survival difference among the sub-groups. Based on the prognostic value of the molecular sub-groups, the goal was to build a classifier that can assign each GBM patient a molecular sub-group. We compared the prediction accuracy of a gene based vs an isoform based classifier to identify sub-group and found that isoform based classifier is a better predictor (85% vs 90%). Using the Random forest feature selection we have built a classifier based on the expression of 121 isoforms that is ~91% accurate and have developed a high throughput RT-qPCR assay to measure the expression of these discriminatory isoforms. We have successfully validated the classifier to identify the molecular sub-group in an independent cohort of GBM patient samples from the Human Brain Tumor Tissue bank at University of Pennsylvania. the study has led to the development of a classification assay for GBM patient sub-grouping and suggests that isoform based expression analysis can lead to better molecular classification of cancer, a requirement for the quest of personalized therapy.

V. EXAMPLES

The invention is now described with reference to the following examples. These examples are provided for the purpose of illustration only and the invention should in no way be construed as being limited to these examples but rather should be construed to encompass any and all variations that become evident as a result of the teaching provided herein.

Example 1: Materials and Methods

Recent genome-wide studies have discovered that the majority of human genes produce multiple transcript-variants and protein isoforms, which could be involved in different functional pathways.[6] Moreover, altered expression of transcript-variants and protein isoforms for numerous genes is linked with cancer and its prognosis, as cancer cells manipulate regulatory mechanisms to express specific isoforms that confer drug resistance and survival advantages.[7] For example, cancer-associated alterations in alternative exons and splicing machinery have been identified in cancer samples,[8-13] demonstrating the efficacy of specific transcript-variants as diagnostic and prognostic markers.[14]

Statistical analysis was performed on The Cancer Genome Atlas (TCGA) datasets to determine differentially expressed genes and isoforms between GBM and normal brain. Machine-learning approaches were applied to derive robust stratification of GBM samples, select the most discriminatory transcript-variants and build an accurate classifier. A high-throughput RT-qPCR assay was designed to quantify the expression of selected transcript-variants and to validate the classifier in an independent GBM cohort. The entire process is depicted in the flow chart of FIG. 7.

The OpenArray platform with 168-plate format was used for RT-qPCR assays to measure the expression of transcripts selected in the classifier. The GBM samples for validating the classifier were obtained from the Human Brain Tumor Tissue bank at The University of Pennsylvania. Collection of brain tumor tissue was approved by the Hospital of the University of Pennsylvania Institutional Review Board, with wavier of informed consent for retrospective review of medical records. Procurement and processing of GBM tumor tissues from HBTTB was approved by the Wistar Institute's Institutional Review Board.

(a) Statistical Analysis:

The expression estimates from the exon-array data were obtained by the Multi-Mapping Bayesian Gene eXpression algorithm for Affymetrix whole-transcript arrays[15] based on Ensembl database (version 56). The estimated expression levels were normalized using the locally weighted scatter-plot smoothing (loess) algorithm.[16] Differentially expressed genes and isoforms between GBM and normal brain samples were determined using the limma method.[17] NMF clustering method[18,19] was applied to cluster the TCGA samples by using the expression of 1,600, non-redundant isoforms with the highest variability across the samples. Kaplan-Meier survival curves among the four GBM isoform expression subtypes are plotted. Log-rank test was applied to test if there were a difference between the survival curves. Random Forest-based classification and feature-variable selection algorithms[20,21] were applied to build the classifier for subtype prediction.

(b) Preprocessing of TCGA Exon-Array Data:

We downloaded the unprocessed Affymetrix Exon-array datasets for 426 GBM samples and 10 normal brain samples (control samples) from the TCGA data portal. We removed 7 GBM samples for which no survival information was available. We, therefore, analyzed raw exon-array data of 419 GBM and 10 normal brain samples. The transcript (isoform)-level and gene-level expression estimates were obtained by the Multi-Mapping Bayesian Gene eXpression (MMBGX) algorithm[15] for Affymetrix whole-transcript arrays, based on Ensemble database (version 56), which contains a total of 114,930 different transcript annotations that correspond to 35,612 different gene models. This method takes into account the multi-mapping structure between probes of the exon-array and the features the probes target. The MMBGX algorithm was published as an R package. The estimated expression values were then normalized across the samples, using the locally weighted scatter plot smoothing (loess) algorithm[16].

After obtaining the isoform-level gene expression estimates and data normalization, the subgroup discovery from TCGA GBM samples was performed by following data-filtering and clustering methods that were applied in previous TCGA publications.[3]

(C) Data Filtering (Selection of Most Variable Isoforms/Transcript Variants for Sample Clustering):

Two filters were applied here. The first filter was applied to retain only one isoform among highly correlated isoforms of same gene. Two isoforms of a gene are considered highly correlated if the Pearson's correlation coefficient of isoform-level expressions across the samples is higher than 0.8. The isoform with highest coefficient of variation (CV), highest variability across patients, was retained among the correlated isoforms of a gene. The second filter was applied to eliminate low-variable isoforms across the patients. We selected 1,600 isoforms with the highest variability across patients, using CV (coefficient of variation). Unlike standard deviation, which is heavily affected by the mean value of the data set, CV is a dimensionless number and a way to penalize the expressions with overall high expression values.

(d) Identification of GBM Subgroups Based on Isoform-Level Expression Using Consensus Non-Negative Matrix Factorization (NMF) Clustering:

We applied consensus NMF clustering approach to group the samples. This approach has been shown to be less sensitive to a priori selection of genes or initial conditions and having a better performance than hierarchical clustering and self-organizing maps[18]. NMF analysis was performed on expression matrix of 1600 transcripts and 419 samples using R package "NMF"[19]. To obtain non-negative matrices we used log transformed values to which the absolute value of the lowest log value has been added. For rank k=2-7, consensus matrices were obtained by taking the average of over 50 connectivity matrices. The stability of the decompositions was evaluated using a cophenetic correlation coefficient and visualization (FIG. 6) of a heat map plot of the consensus clustering matrix (heat map shown in FIG. 6A of parent application). As the NMF finds different solutions for different initial conditions, the factorizations were repeated 100 times using the previously determined rank and evaluated according to their factorization approximation error. The factorization with the lowest approximation error was retained.

The silhouette width[22] was computed to filter out expression profiles that were included in a subclass, but that were not a robust representative of the subclass. Observations with a large silhouette width (almost 1) are very well clustered, a small value (around 0) means that the observation lies between two clusters, and observations with a negative values are probably placed in the wrong cluster.

(e) Survival Difference Between Subtypes:

Kaplan-Meier survival curves for the four GBM subtypes are plotted. Log-rank test is applied to test if there is a difference between the survival curves. The R package "survival" was used to do the analysis.[26]

(f) Isoform Based Signature Identification:

Differentially expressed marker isoforms were determined for each sub-type by comparing each sub-type with the other three sub-types using the limma method.[17] The functions implemented in the R package "siggenes" are used to perform SAM analysis to identify genes/isoforms that are differentially expressed in bi-classifications of one subtype vs. all the others and normal vs. tumor. We used the cutoff to be the q-value <0.001.

(g) Identification of an Isoform-Based Classifier for Predicting the GBM Sub-Types:

Diaz-Uriarte and De Andres[20] presented a new method for gene selection that uses randomForest. The main advantage of this method is that it returns very small set of genes that retain high predictive accuracy. The variable selection procedure is based on randomForest using both backward variable elimination and the importance spectrum. It has been shown that this method has comparable performance to other classification methods, including DLDA, KNN, and SVM, and that the new gene selection procedure yields very small sets of genes (often smaller than alternative methods) while preserving predictive accuracy. The algorithms are publicized in the R package of varSelRF. We ran the feature selection algorithm using 3000 trees in the forest during each step of backward elimination and the final randomForest classifier was built using the selected transcripts with 15,000 trees in the forest. All the other parameters are set to be the default values.

For better evaluating the performance of the classifier, we trained the random Forest models on ¾th of the dataset and tested on the remaining ¼th of the dataset. We reported the OOB (out of bag) error rate of the final classifier based on the ¾ training dataset and also the error rate based on the untouched testing data set.

(h) Data Discretization to Transform Continuous Data to Categorical Data:

To derive numerically comparable measures of gene expression between different platforms, we adopted an approach similar to the quantile discretization[41] to translate the classification model trained from exon-array to RT-qPCR assay. Basically, we discretized the data of each platform based on equal frequency binning[23] and converted the discretized data to ranks. Specifically, the fold change expression values of each transcript across all the samples in one platform were sorted in ascending order first. The resulting sorted vectors were then discretized into a predetermined number of bins "b". Every expression value was then replaced by an integer value corresponding to the rank of the bin it falls into. The number of bins "b" was dependent on the sample size and was determined as the closest integer value for sample number divided by a factor of 10. Based on this criterion the number of bins for Penn cohort (206 samples) was 20 and that for TCGA RNA-seq cohort (155 samples) was 15. The randomForest classifier was trained on the discretized data of TCGA isoform-based exon-array core samples for each bin size.

(i) RNA-Seq Data Analysis:

The TCGA GBM paired-end RNA-seq aligned bam files, for a total of 155 patient samples, were downloaded. A subset (76 datasets) of GBM samples have expression profiles from both RNA-seq and exon-array platforms. Two normal brain RNA-seq samples were downloaded from SRA archive (ERR030882 and SRR309262) and analyzed using the same pipeline as the GBM samples. The RNA-seq bam files were converted to raw fastq files by Picard tools. The isoform level expression estimates were obtained by Tophat/Cufflinks pipeline[42] using Ensembl 66 as reference. Cufflinks isoform level expression estimates are normalized by upper quartile normalization.

Similar quartile discretization procedure, described previously, was applied on the RNA-seq normalized data and the classifier trained on the exon-array platform data was applied on the RNA-seq samples for validating the classification model efficiency on data from an independent platform.

(j) Open Array Design:

To translate the classifier that was built based on exon array data to a clinically applicable platform, we decided to measure expression of the desired transcripts using RT-qPCR assay. We searched for commercially available TaqMan assays on Life Technology Inc. website and selected assays that would detect the transcript of choice and the co-detected transcripts were highly correlated in expression pattern. Care was taken to avoid assays that would co-detect transcripts showing negative correlation at expression with the desired transcript.

Out of the 214 transcripts selected by the classifier, we picked assays for 126 transcripts including HOTAIR, a gene differentially expressed between neural and proneural subtypes. We also included assays for four housekeeping genes—POLR2A, GAPDH, β2-microglobulin, and ACTINβ, a marker for classical subgroup—NES, and another marker for mesenchymal subgroup-CHI3L1, eight transcripts mostly upregulated and another seven transcripts mostly down-regulated in GBM patients relative to normal brain tissue. We decided to use the OpenArray platform with 168 plate format to perform these assays in a highthroughput manner. Of the 126 assays, five assays did not work well so we excluded these from the analysis and hence the classifier that was translated to an RT-qPCR assay is based on the expression of 121 target transcripts with four housekeeping genes as controls for normalization, and another 15 assays as controls for general behaviour of expression changes in GBM patient samples relative to normal brain tissue. These targets and controls are identified in Table 1.

(k) Performance of the Diagnostic Method

The diagnostic method is illustrated in the flow chart of FIG. 8.

i. RNA Isolation:

The GBM samples processed for RNA isolation were obtained from the Human Brain Tumor Tissue bank (HBTTB) at The University of Pennsylvania. Collection of brain tumor tissue was approved by the Hospital of the University of Pennsylvania Institutional Review Board, with wavier of informed consent for retrospective review of medical records. Procurement and processing of GBM tumor tissues from HBTTB was approved by the Wistar Institute's Institutional Review Board. The samples received were stored frozen in RNA later (Life Technologies Inc.).

Each sample was thawed on ice and RNA later was removed before transferring the tissue to Tri Reagent (Sigma Inc.). We used 1 ml of Tri reagent for approximately 50-75 mg of tissue, which was immediately homogenized using disposable homogenization tips (Omni International Inc.) and samples transferred to 1.5 ml eppendorf tubes. The homogenized samples were processed to isolate RNA as per manufacturer's instruction (Sigma Inc.). The concentration and purification of RNA was estimated by measuring absorbance at 260, 280, and 230 nm using the nanodrop instrument's nucleic acid-RNA program. RNA samples with poor 260/280 ratios (<1.8) were extracted with Tri reagent and samples with poor 260/230 ratio (<1.8) were re-precipitated with sodium acetate and ethanol overnight, washed with 70% ethanol and resuspended in DEPC treated water before concentration measurement and purification assessment. To check for RNA integrity all samples were analyzed on bioanalyzer using a RNA pico chip (Agilent technologies Inc.) and only samples with RIN≥5.0 were selected for RT-qPCR analysis. Normal brain RNA was purchased from Agilent Technologies Inc.

ii. RT-qPCR Analysis:

RNA samples with abs 260/280>1.8, 260/230>1.8, and RIN≥5.0 were selected for RT-qPCR analysis. For RT reaction, 2.5 µg of RNA was reverse transcribed using the high capacity cDNA reverse transcriptase kit (Applied Biosystems Inc.) according to the manufacturer's instruction. For the qPCR analysis, the cDNA (the RT reaction) was mixed with OpenArray real time RT-PCR master mix (Applied Biosystems Inc.) in the 384 well OpenArray loading plates as per the plate map and instructions for 168 plate format OpenArray RT-qPCR assay. The Openarray set using an autoloader loads the Openarray plate which is then run on the OpenArray™ NT cycler to collect data. Each 168-format OpenArray plate can estimate the expression of up to 168 transcripts/genes for 16 samples and three OpenArray plates can be run together on the cycler. The expression of the transcripts in GBM samples as fold changes was calculated relative to normal brain tissue using POLR2A as the normalization control based on the deldelct method.

iii. Analysis of RT-qPCR Results

As illustrated in FIG. 8, the PCR data was added to the PCR data matrix as the 207$^{th}$ row. The PCR data matrix is the data of 206 rows and 121 columns. Rows represent patients and columns represent Transcript IDs. Each entry in this matrix is a fold-change value (ratio of expression of a transcript in a patient sample over the expression of that transcript in normal brain) for the Xth transcript and Yth patient.

Thereafter, as shown in FIG. 8, the data is discretized, the classifier is applied and the probability for the sample to belong to each of the four subtypes is generated.

Example 2: Extensive Isoform-Level Changes Occur in the GBM Transcriptome

Unprocessed exon-array expression data and clinical details for 419 GBM and 10 normal brain samples were downloaded from the TCGA data portal. A subset of 173 GBM samples, marked as "core samples," was further stratified by the method of Verhaak et al[3] into one of the four molecular groups (namely, neural-N, proneural-PN, mesenchymal-M, and classical-CL) (data not shown). The transcript (isoform)-level and gene-level expression estimates were obtained for a total of 114,930 different transcript-variants that correspond to 35,612 different gene models (Ensembl database, version 56). While the comparative statistical analysis between GBM and normal brain at the gene-level produced 2,834 genes as differentially expressed, similar analysis at the isoform-level revealed that a total of 7,313 transcript-variants that correspond to 4,215 genes were significantly altered in GBMs (q≤0.001 and fold-change ≥2.0).

The following Table 3 shows transcriptome analysis at the isoform-level, e.g., the number of up- and downregulated genes or transcripts identified in the The Cancer Genome Atlas (TCGA) GBM cohort's exon-array data.

TABLE 3

TCGA Exon-array Data Analysis

| Response of Gene | Gene Level | Isoform (transcript variant) level |
|---|---|---|
| Upregulated | 912 | 2085 |
| Downregulated | 1922 | 5228 |

The number of genes that are misregulated at the gene-level alone was found to be 174, at the isoform-level alone was found to be 1555. The number of genes that are misregulated at both levels are 2660. We also observed that the transcript-variants of 44 genes (e.g. RTN3, DCLK2, AAK1, ACTN1), primarily associated with cellular assembly and organization, frequently showed opposite patterns of gene isoform expression in GBMs compared to normal brain, with one isoform being upregulated and another isoform of the same gene is downregulated. We validated the isoform-level expression changes by RT-qPCR in primary GBM samples from human brain tumor tissue bank (HBTTB) at The University of Pennsylvania (Penn) for 15 of 16 isoform transcripts corresponding to 6 genes. This shows that the isoform-level expression patterns obtained by analyzing TCGA exon-array datasets can be validated across a cohort of independent GBM patient samples (data not shown) using an independent assay. Since, for a large number of genes, we observed significant expression differences at the isoform-level but not at the overall gene-level, we investigated whether the transcriptome changes at the isoform-level can provide better GBM stratification in terms of overall prognosis and classification accuracy in the TCGA GBM cohort. The scheme that was followed for building an isoform-based classifier for GBM patient, including subtyping and translating the classifier to a clinically applicable GBM diagnostic assay included the steps in order of:

TCGA GMB cohort exon array data→Isoform level, expression-based molecular subtypes→Build a classifier; select set of isoforms→Translate classifier to an RTqPCR-based assay→Test and validate the RT-qPCR based assay→Diagnostic assay to identify GBM subtype.

Figure 5:
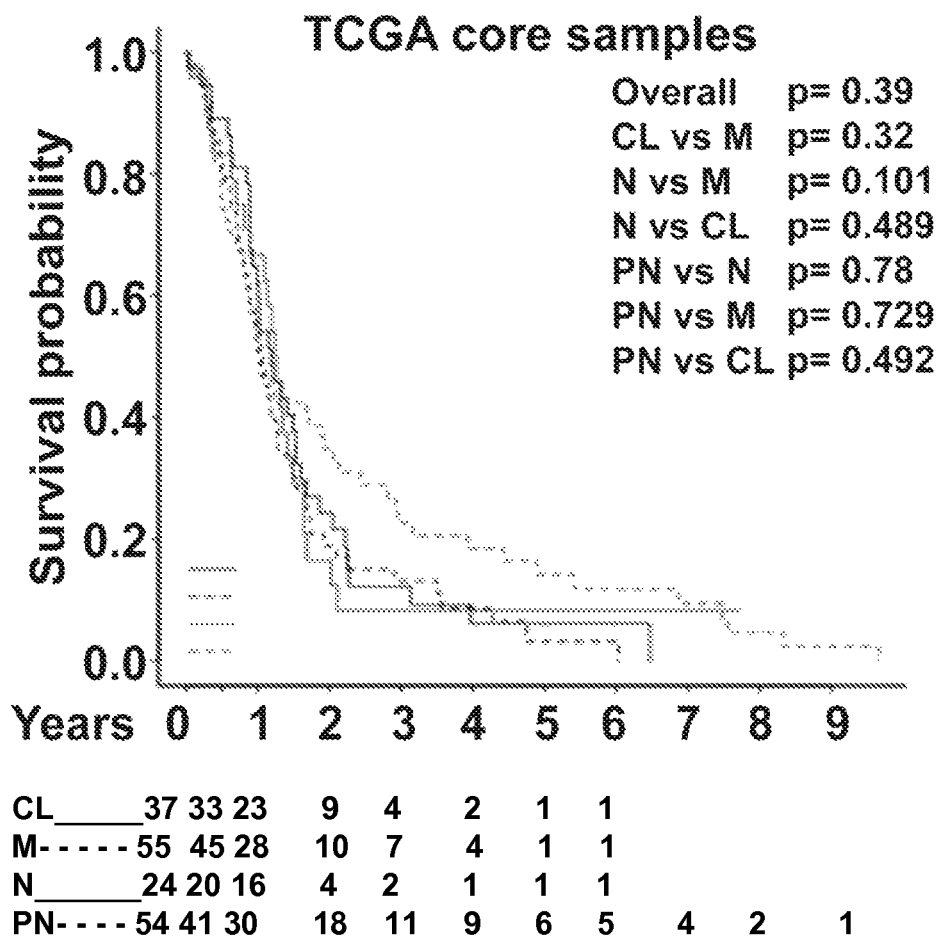
FIG. 5 is a Kaplan-Meier survival curve showing the TCGA classification of GBM patients into 4 groups using the known 804 gene based classifier.
Figure 6:
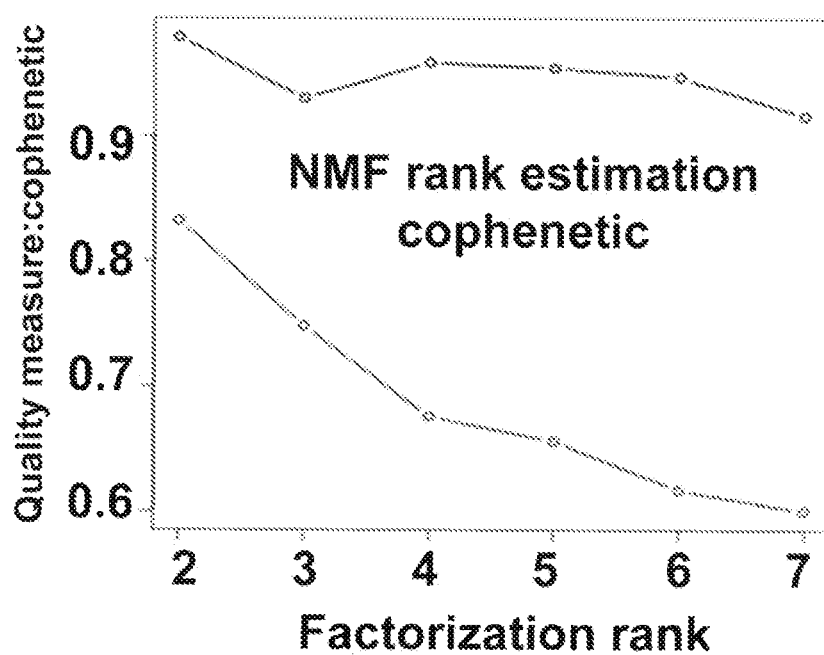
FIG. 6 is a graph showing that stable clustering at the isoform level can be achieved in four groups, using isoform expression data of 197 samples and 1600 isoforms with the highest variability across patients using the coefficient of variation, plotting a cophenetic quality measure vs. factorization rank.

Example 3: Isoform-Level Gene Expression Signatures Show Improved Predictive and Prognostic Value in GBM Patient Stratification Although the TCGA core samples were divided into one of four subtypes—N, PN, M, and CL—based on the gene-level expression signature of 840 genes, no statistically significant survival differences were observed between the subtypes (See FIG. 5)[3]. Since the isoform-level expression analysis captured significantly more transcriptome changes than the gene-level analysis, we evaluated the clustering of GBM samples by using the isoform-level expression profile. We first selected the most-variable transcript-variants across the tumor samples and performed consensus non-negative matrix factorization (NMF) clustering to stratify GBM patient samples. We identified four major clusters, hereafter called "isoform-based groups," using the expression of 1,600 of the most variable transcripts (See FIG. 6). The NMF-based clustering based on the data of FIG. 6 is not shown.

We identified the four GBM groups as "proneural," "mesenchymal," "classical," and "neural," based on the concordance in cluster membership calls between the isoform-based and gene-based groupings in the TCGA publication[3]

An isoform-level, expression-based clustering of GBM patients from the TCGA cohort, shown as a non-negative matrix factorization (NMF)-method-based clustering of 419 GBM patient samples based on the expression of 1,600 of the most variable transcripts/isoforms across the patients was shown as FIG. 2A in the parent US provisional application. Four clusters were formed, and on top, the distribution of 173 TCGA core samples in each cluster was shown. The subtypes of the TCGA core samples are proneural-PN, mesenchymal-M, neural-N, and classical-CL (data not shown).

In order to prepare homogeneous, isoform-based GBM subgroups, we filtered out samples that were not good representatives of a subgroup by employing the silhouette width method.[22]

Table 4 is a concordance table showing the comparison of TCGA's core sample assignment to four subtypes based on gene-level (Verhaak et al.[3]) and isoform-level expression (isoform-based clustering).

TABLE 4

| | | Gene based clustering (Verhaak et al) | | | | |
|---|---|---|---|---|---|---|
| | | PN | N | CL | M | Total |
| Isoform-based clustering | PN | 43 | 2 | 1 | 0 | 46 |
| | N | 4 | 25 | 10 | 6 | 44 |
| | CL | 2 | 0 | 25 | 2 | 28 |
| | M | 2 | 1 | 5 | 44 | 51 |
| | Total | 48 | 28 | 41 | 52 | 169 |

This resulted in the removal of 77 samples, leading to a final set of 75 neural (N), 95 proneural (PN), 85 mesenchymal (M), and 87 classical (CL) GBM samples—for a total of 342 as most representative of the four groups, hereafter called "isoform-based core samples." Among the 169 common to both TCGA and isoform-based core samples (Table 4), 32 (19%) were reassigned to a different subgroup by the described isoform-based signature. Surprisingly, the switching of these few GBM samples resulted in the PN subgroup to have statistically significant better survival (FIGS. 1A, 1B and 2).

To develop a diagnostic test for predicting the subtype of a GBM patient, we built a four-class classification model by using the isoform-based core samples as the training set. In order to translate the classification model that was trained on data from one platform (exon-array) to data from an independent platform (RNA-seq or RT-qPCR), we applied a data discretization method for converting continuous data values into categorical data.[23]

Briefly described the application of data discretization to build a new classifier based on Liu H et al[23] follows the steps:

First, the expression values of each transcript across all the samples in one platform are sorted in ascending order. Then the resulting sorted vector is discretized into a predetermined number of bins b (b+20). Each bin has equal size. Every expression value is replaced by an integer value corresponding to the rank of the bin it falls into. The formula is:

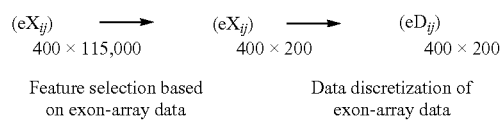

-continued $$(pD_{ij}) \longleftarrow (pY_{ij})$$
$$00 \times 200 \quad 400 \times 200$$

Data discretization of
RT PCR data.

We discretized the fold-change levels (GBM over normal brain) of each transcript expression into different numbers of categories (with equal bin sizes) to determine if finer or coarser discretization improves classification accuracy. Prior to building the classification model, we applied a random-Forest-based variable selection algorithm[20] to select a small set of non-redundant genes or isoforms, using discretized gene-level or isoform-level expression fold-changes, respectively. We first compared the prediction accuracy of a gene-based versus an isoform-based classifier to correctly call the subtype of a GBM sample, and found that the isoform-based classifier is better both in terms of numbers of variables (genes/isoforms) required and prediction accuracy (See FIG. 3A).

For example, while the isoform-based randomForest model achieved 90% accuracy with as few as 50 isoforms as feature variables, the gene-based model required more than 100 genes as feature variables for comparable accuracy to the isoform-based model. By selecting 214 transcripts/isoforms (Table 1) as the most discriminative feature variables between the four GBM subgroups, we created a random-Forest classifier, based on isoform-level expression, for subtype prediction. Using the 214 transcript variants as the number of variables/features selected by RandomForest feature selection, with an OOB error rate; and error rate based on independent test set of 0.063, using 4 housekeeping genes Polr2a, GAPDH, B2M, and B-Action; 147 variable transcripts with 18 non-coding transcripts (8 were consistently up; 8 were consistently down), the RandomForest algorithm discovered sets of isoforms that are most discriminative between the four sub-groups of GBMs. In one example, the six most discrimination transcripts were: ENST00000448418; ENST00000259056; ENST00000470802; ENST00000233946; ENST00000441301 and ENST00000225441. The accuracy of the final selected classifier based on cross-validation analysis (leave-one-out or out-of-bag [OOB] approach) is 93.6%.

We further tested the classifier by dividing the isoform-based core samples into ¾th as training-set and ¼th as test-set. The classification model generated with the use of data from the training set was applied to the test set. The results of this independent testing agreed with those of the leave-one-out cross-validation analysis in 99% of the sample calls in the test set, confirming that the algorithm effectively distinguishes the four GBM subgroups. Many interesting genes that reflect molecular differences between the four GBM subgroups were selected among the 214 isoforms, for example, EGFR, known to be highly amplified in the CL subgroup,[3,24] and MET, a gene associated with epithelial to mesenchymal transition.[25]

Example 4: Translation of Isoform-Level Gene Panel to Clinically Translatable Platform and Validation of the Classifier on Two Independent Cohorts of GBM Patient Samples Since the isoform-based classifier has achieved a prediction accuracy of >90% with fewer numbers of transcripts than the gene-based classifier, we decided to translate the isoform-level gene panel (214 transcripts) to an RT-qPCR-based assay for a clinically applicable diagnostic test. We used the OpenArray Real Time PCR platform (Life Technologies Corporation) to perform the RT-qPCR assay for selected transcripts and tested it on an independent cohort of GBM tumor tissues. Because we observed that the accuracy of the classifier did not vary significantly whether we chose as few as 100 isoforms or as many as 214 isoforms in the classification model (~3% decrease for the 100-transcript model compared with the 214-transcript model), we selected the 126 most reliable transcript assays from the commercially available TaqMan chemistry-based qPCR assays. In addition, we included assays for 15 control transcripts (8 up- and 7 downregulated) that are differentially expressed in most GBM samples when compared to normal brain transcriptome. We then tested the customized high-throughput RT-qPCR assay on an independent cohort of 206 primary GBM tumor tissues obtained from Penn (data not shown). We observed that the qPCR assays for 5 out of 126 transcripts failed and so removed them from further analysis. We retrained the classifier with 121 transcripts (identified as targets in Table 1) on isoform-based core samples from TCGA and found a prediction accuracy loss of only 1.5%.

As a first step, we evaluated the transition of the classifier from exon-array to an independent platform by applying on 155 RNA-seq samples downloaded from the TCGA dataportal. Based on 76 GBM samples that overlapped with the isoform-level core samples and were profiled by both exon-array and RNA-seq methods, we found that the classifier made 90% similar sub-type calls between the two platforms, and achieved 93% prediction accuracy when compared with the true-class labels (data not shown). Therefore, the classifier trained on discretized fold-change data provided a platform independent isoform-level gene signature with a high degree of concordance and prediction accuracy.

Next, we tested the classifier on the Penn cohort of GBM patient samples, by using the RT-qPCR based assay designed above. First, we analyzed the concordance between the expression estimates, in terms of fold change relative to normal, obtained from exon-array and RT-qPCR assays. We observed similar expression patterns for 14 of the 15 control transcripts between RT-qPCR and exon-array data analysis (data not shown). To evaluate the data correlation between the two platforms, mean fold changes of 121 transcripts between the TCGA and Penn cohorts were plotted and compared (FIG. 3B). The strong linear relationship between the two datasets indicates that the classifier built on expression data from the exon-array platform can be translated to another independent platform-RT-qPCR, and isoform-level expression patterns for GBM patients is comparable across independent cohorts of patients.

We applied the retrained classifier on the 206 GBM patient samples to identify each patient subtype. For each sample, the classifier calculates the probabilities that it belongs to one of the four subtypes, and the algorithm assigns the sample to the subtype with the highest probability (data not shown). The described results indicate that 52 (25.2%), 41 (19.9%), 50 (24.2%), and 63 (30.5%) of GBM patients belong to PN, N, M, and CL groups, respectively. A closer look revealed that for about 16 (~8%) samples, the difference in the top two probabilities for subtype assignment is less than 0.05%, which we defined as "low-confidence." However, for these samples the described classifier can confidently eliminate the assignment to the other two subtypes. Most of these ambiguous cases involve a decision between neural versus proneural (7/16) and neural versus classical (4/16).

To address the issue of reproducibility, we independently re-isolated RNA and performed the RT-qPCR analysis on three of the GBM patient samples and found good correlation (r~0.9) between the two RT-qPCR datasets. Moreover, when the described classification algorithm was applied, all three samples were assigned to the same subtype as before (data not shown). To further validate the assignment of subtypes, we looked at the expression of known markers for each subtype.[26] As expected, we observed higher expression of the neural marker GABRA1, proneural marker DCX, mesenchymal markers CHI3L1 and MET, and classical marker NES in samples belonging to the N, PN, M, and CL subtypes, respectively (see FIG. 3C).

In conclusion, we have developed an RT-qPCR-based assay that can reproducibly predict the molecular subtype of GBM patients based on the relative expression of only 121 transcripts/isoforms in the tumor tissue.

Figure 4B:
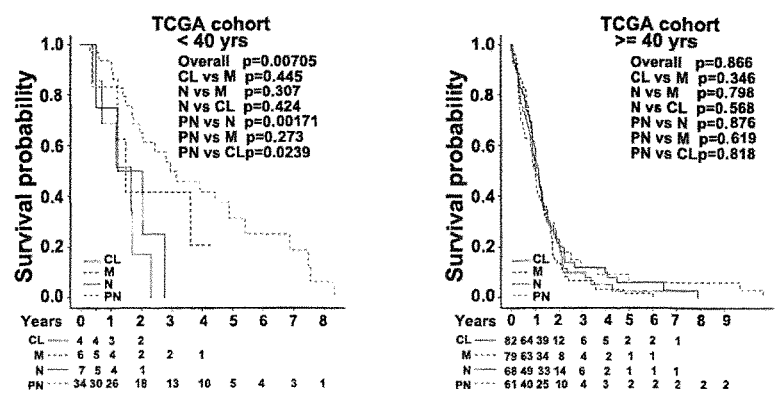
FIG. 4B are two Kaplan-Meier survival plots for isoform-based core samples from TCGA cohort of GBM patients divided by age as <40 yrs and ≥40 yrs at time of diagnosis. The statistical significance of each plot is indicated.

Example 5: Prognostic Significance of the GBM Subtypes and the Contribution of Other Factors to Better Prognosis The molecular stratification of the TCGA GBM cohort by the isoform-based gene signature showed that the PN subgroup has significantly better overall survival than the other three groups. We plotted the survival curves for the four predicted groups of the Penn GBM cohort. However, to the inventors' surprise, we did not observe a better overall survival for the PN group. Instead, we found that the neural group had a significantly better survival rate compared to the classical and mesenchymal subtypes, a difference that remained significant even after the patient samples with low-confidence subtype scores were omitted (FIG. 4A and data not shown). This result prompted us to investigate the characteristic difference between the two cohort populations (Table 5).

found that most of the younger GBM patients in the TCGA cohort were classified as PN (34/51), and these patients had much longer survival compared to the older PN patients (Table 6 and FIG. 4B).

TABLE 6

Distribution of GBM patients by age at diagnosis below and over 40 yrs and the representation of female and male patients among them in each of the four subtypes.

|  |  | TCGA samples | | | | Penn samples | | | |
|---|---|---|---|---|---|---|---|---|---|
|  |  | PN | N | CL | M | PN | N | CL | M |
| Overall |  | 95 | 76 | 86 | 85 | 52 | 41 | 63 | 50 |
| Age < 40 yrs |  | 34 | 7 | 4 | 6 | 6 | 1 | 4 | 0 |
| Gender | Male | 14 | 4 | 0 | 1 | 4 | 1 | 2 | 0 |
|  | Female | 20 | 3 | 4 | 5 | 2 | 0 | 2 | 0 |
| Age > 40 yrs |  | 61 | 69 | 82 | 79 | 46 | 40 | 59 | 50 |
| Gender | Male | 39 | 48 | 47 | 51 | 32 | 19 | 30 | 34 |
|  | Female | 22 | 21 | 35 | 28 | 14 | 21 | 29 | 16 |

TABLE 5

Distribution of GBM patients in the two cohorts based on age.

| TCGA samples | | | | | Penn samples | | | | |
|---|---|---|---|---|---|---|---|---|---|
| Age group (yrs) | | | | | | | | | |
| <40 | 40-50 | 51-60 | 61-70 | >70 | <40 | 40-50 | 51-60 | 61-70 | >70 |
| Patient (%) 14.62 | 16.37 | 26.02 | 26.6 | 14.91 | 5.78 | 18.42 | 25.78 | 25.78 | 22.1 |

One striking difference was in the representation of younger GBM patients (<40 yrs old at the time of diagnosis) between the two cohorts; 27 while 14.6% in TCGA were younger, only 5.8% were younger in the Penn cohort. We Another interesting observation was that the survival among the younger TCGA patients in the PN group from the MD Anderson collection center was almost twice that of the young PN patients from the other centers (Table 7).

TABLE 7

Distribution of patients in the TCGA cohort younger than 40 yrs from MD Anderson and other centers and their average survival for the four subtypes.

|  | PN | | N | | CL | | M | |
|---|---|---|---|---|---|---|---|---|
|  | MD-A | Others | MD-A | Others | MD-A | Others | MD-A | Others |
| Patient no. | 15 | 19 | 2 | 5 | 2 | 5 | 1 | 6 |
| Avg. survival (days) | 1520 | 748 | 431 | 510 | 736 | 561 | 492 | 583 |

Figure 4C:
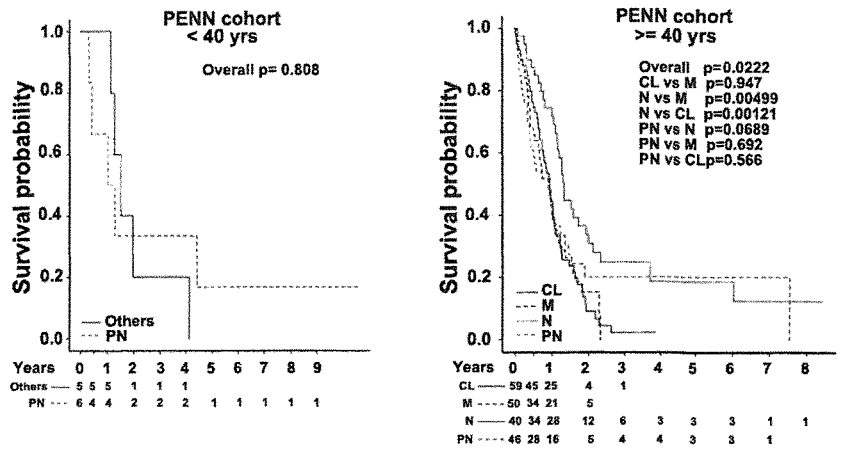
FIG. 4C are two Kaplan-Meier survival plots for isoform-based core samples from Penn cohort of GBM patients divided by age as <40 yrs and ≥40 yrs at time of diagnosis. The statistical significance of each plot is indicated.

Hence, we decided to re-plot the survival curves for the TCGA and Penn cohorts separately for younger (<40 years) and older patients (>40 years) (FIGS. 4B and 4C).

Our results clearly demonstrate that the prognostic significance of the PN group in terms of survival is valid only for the younger patients, and among the older patients, the PN group has the poorest six-month survival rate in both the TCGA and Penn cohorts (Table 8).

TABLE 8

Comparison of survival among the TCGA cohort and Penn cohort of GBM patients (≥40 yrs) belonging to the four subtypes

| Survival | TCGA cohort (%) | | | Penn cohort (%) | | |
|---|---|---|---|---|---|---|
| (months) | 6 | 12 | 24 | 6 | 12 | 24 |
| N | 72.0 | 47.8 | 20.5 | 85.0 | 70.0 | 30.0 |
| PN | 65.5 | 41.0 | 16.4 | 60.8 | 34.7 | 10.9 |
| M | 79.5 | 43.6 | 10.3 | 68.0 | 42.0 | 10.0 |
| CL | 77.2 | 46.8 | 15.2 | 76.2 | 42.3 | 6.8 |

Among the older GBM patients, the neural group shows significantly better survival in the Penn cohort and, in general, the longer-surviving (more than two years after diagnosis) N patients tend to be older than 50 years, unlike the longer-surviving PN patients who tend to be younger (FIG. 4C). Also worth noting is the difference between survival of the Penn N and TCGA N groups. While the six-month survival rate is quite similar between the two groups, the one-year survival rate for the Penn N group is significantly higher (70% of patients were alive after one year post-treatment) than the TCGA N group (only 48% of patients were alive after one year post-treatment) (Table 8). While most patients grouped in the TCGA PN, M, and N groups were males, only the PN and M groups in the Penn cohort had a higher representation of males. Interestingly, a small proportion of GBM patients (5.6% in the Penn cohort and 7% in the TCGA cohort) survived for at least three years, and most of the patients in the Penn cohort belonged to either the PN or N subtype, whereas in the TCGA cohort they were distributed across all four subtypes (FIGS. 4B and 4C).

Based on the results described above, this analysis agrees with the GBM field's general belief that patients who are young and have a PN subtype tend to have better prognoses.[28] We also found that with the current standard therapy available for the disease, older patients with the PN subtype have a poor prognosis, while the best prognosis is for the N group of patients.

Example 6: Analysis Using Modified PIGExClass

Having established a prognostic stratification of GBM samples based on isoform-level gene expression clustering, we sought to (1) design a universal classification model that will be independent of the gene expression measuring platform, and (2) identify a small subset of genes or isoforms that are discriminatory between the four subgroups. To determine the type of the classification variable (genes vs isoforms), we compared the prediction accuracy of a gene-based versus an isoform-based classifier to correctly call the subtype of a GBM sample, and found that the isoform-based classifier is better both in terms of numbers of variables (genes/isoforms) required and prediction accuracy (FIG. 3A). For example, while the isoform-based randomForest model achieved 90% accuracy with as few as 50 isoforms as feature variables, the gene-based model required more than 100 genes as feature variables for comparable accuracy to the isoform-based model. We also evaluated the performance of gene-based classifier vs isoform-based classifier when the initial NMF cluster identification was performed using the gene-level expression (data not shown; provided as Supplementary Figure S3[46]). Even in this scenario, an isoform-based classifier had a better performance than the gene-based classifier. In the final "classification" step, by selecting 213 transcripts/isoforms as the most discriminative variables between the four GBM subgroups, a randomForest classifier is built for subtype prediction.

The accuracy of the final selected classifier based on cross-validation analysis (out-of-bag [OOB] approach) is 93.6%. The classifier was further tested by dividing the isoform-based core samples into $\frac{3}{4}^{th}$ as training-set and $\frac{1}{4}^{th}$ as test-set. The classification model generated from the training set was applied to the test set. The results of this additional testing agreed with those of the OOB approach in 99% of the sample calls in the test set, confirming that the algorithm effectively distinguishes the four subgroups. We also compared the error rate with and without discretization on the training data set and find that the OOB error rate decreases from 8.6% to 6.4% after discretization, suggesting that data discretization is not only critical for platform transition but also important for classifier's accuracy within the same platform. Genes that reflect molecular differences between the subgroups were selected among the 213 isoforms, for example, EGFR, known to be highly amplified in the CL subgroup[13,32], and MET, a gene associated with epithelial to mesenchymal transition[47].

A. Translation of Isoform-Level Gene Panel to Clinically Translatable Platform and Validation of the Classifier Since the isoform-based classifier from PIGExClass has achieved a prediction accuracy of >90% with fewer numbers of transcripts than the gene-based classifier, we decided to translate the classifier's isoform-level gene-panel (213 transcripts) to an RT-qPCR-based assay. Because we observed that the accuracy of the randomForest classifier did not vary significantly whether we chose as few as 100 isoforms or as many as 213 isoforms in the classification model (FIG. 3A, ~3% decrease in accuracy), we selected the 121 most reliable commercially available TaqMan chemistry-based qPCR assays, and translated these transcript assays to RT-qPCR platform (Table 1). We retrained the classifier with 121 transcripts on isoform-based core samples from TCGA and found a prediction accuracy loss of only 1.5%.

As a first step, we evaluated the transition of the classifier from exon-array to an independent platform by applying on 155 RNA-seq TCGA samples. We found that the data discretization with equal-frequency binning gave better classification accuracy than that based on equal-width binning We, therefore adopted the data-discretization with equal frequency binning for data transition across platforms. Based on 76 GBM samples that overlapped with the isoform-level core samples and were profiled by both exon-array and RNA-seq methods, we found that the classifier made 90% similar sub-type calls between the two platforms, and achieved 93% prediction accuracy when compared with the true-class labels (Supplemental Table S4[46] and Table 9 below).

Table 9 shows the confusion matrix when the classifier was applied on the RNA-seq data for the 76 GBM patients from TCGA for who exon-array expression data was also available.

|  |  | Predicted labels | | | | |
|---|---|---|---|---|---|---|
|  |  | N | PN | M | CL | Class Error |
| True | N (22) | 16 | 1 | 1 | 6 | 0.27 |
| Labels | PN (18) | 0 | 18 | 0 | 0 | 0.00 |
|  | M (20) | 0 | 0 | 20 | 0 | 0.00 |
|  | CL (16) | 0 | 0 | 0 | 16 | 0.00 |

However, the classifier's accuracy was only 66% on these 76 GBM samples if data discretization step was omitted. The stability in the classification accuracy across the two platforms is primarily due to reduced variability in FCCVs and increased correlation across platforms (FIG. 3B). Therefore, the classifier trained on discretized fold-change data provided a platform independent isoform-level gene signature with a high degree of concordance and prediction accuracy.

Next, we tested the classifier on the Penn-cohort of 206 samples, by using the RT-qPCR based assay designed above. First, we analyzed the concordance between the expression estimates, in terms of fold change relative to normal, obtained from exon-array and RT-qPCR assays. We observed similar expression patterns for 14 of the 15 control transcripts between RT-qPCR and exon-array data analysis, as shown in Table 10. The top 8 and bottom 7 transcripts represented the selected up- and down-regulated transcripts respectively.

TABLE 10

Exon Array And RT-PCR Data Agree In Expression Of Up And Down-Regulated Transcripts

| Transcript ID | Gene | Median Fold Changes (GBM/Normal) | |
|---|---|---|---|
|  |  | Exon array 9TCGA) | RT-qPCR (HBTTB cohort) |
| ENST00000373020 | TSPAN6 | 3.1 | 12.0 |
| ENST00000218340 | RP2 | 2.7 | 5.6 |
| ENST00000483967 | EZH2 | 2.9 | 17.8 |
| ENST00000263635 | TANC1 | 2.7 | 5.6 |
| ENST00000450318 | NUSAP1 | 2.7 | 6.1 |
| ENST00000411739 | NEDD1 | 2.7 | 2.3 |
| ENST00000478293 | MKI67 | 2.6 | −2.4 |
| ENST00000295633 | FSTL1 | 2.6 | 6.6 |
| ENST00000389722 + ENST00000389723 | SPTB | −7.1 | −9.6 |
| ENST00000381142 | TYRP1 | −6.9 | −17.9 |
| ENST00000369777 | NEURL | −14.4 | −17.7 |
| ENST00000414191 + ENST00000439163 | PLCH1 | −5.2 | −1.5 |
| ENST00000262450 | CHD5 | −5.2 | −15.6 |
| ENST00000322893 | KCNH5 | −5.4 | −26.0 |
| ENST00000304045 | KLK7 | −5.0 | −3496.5 |

To evaluate the data correlation between the two platforms, mean fold changes of 121 transcripts between the TCGA and Penn-cohorts were plotted and compared (FIG. 3C). The strong linear relationship between the two datasets indicates that the classifier built on expression data from the exon-array platform can be translated to RT-qPCR platform, and isoform-level expression patterns for GBM patients is comparable across independent cohorts of patients.

Figure 11:
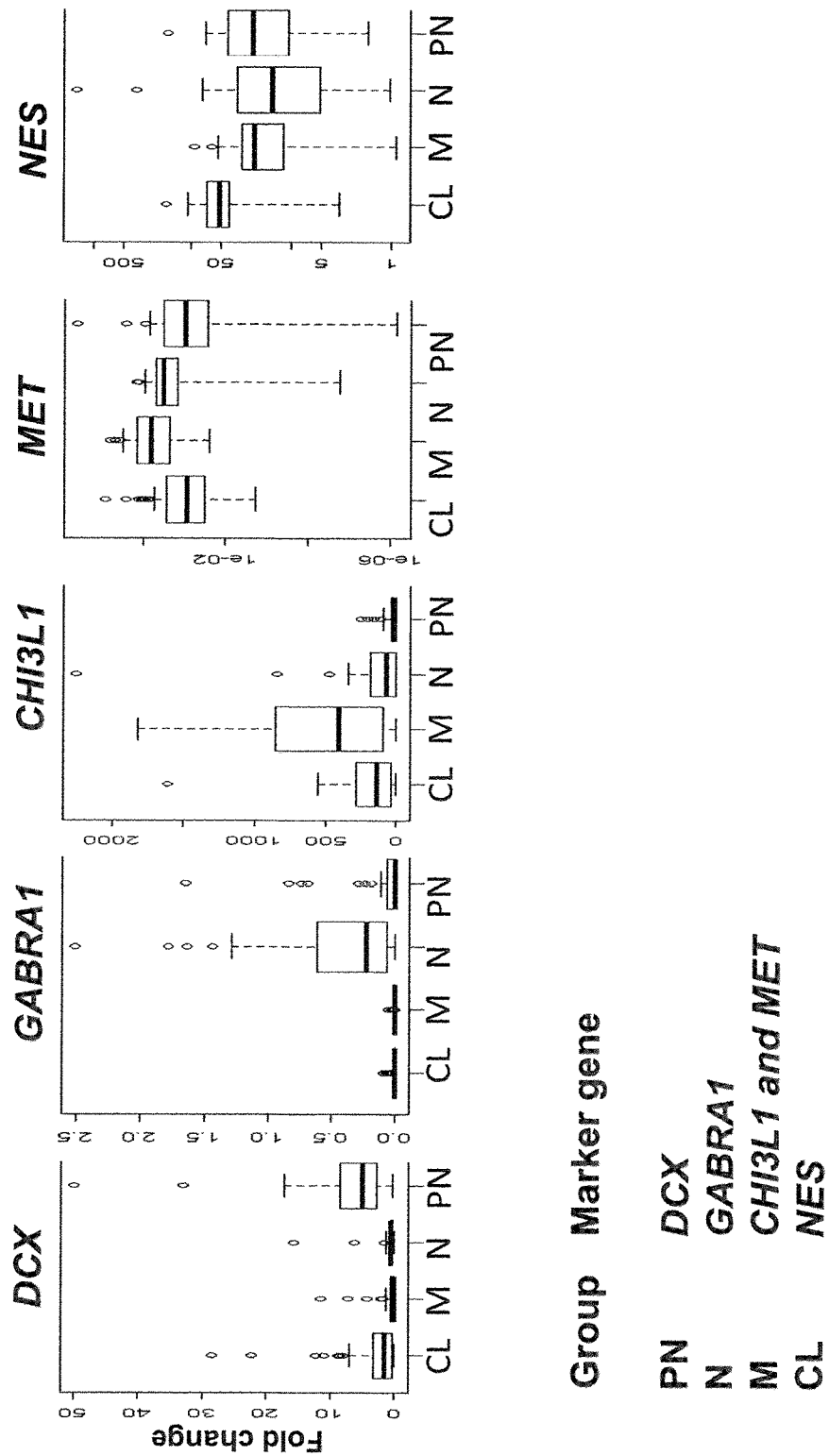
FIG. 11 is a series of boxplot graphs showing subtype specific marker gene expression in the TCGA cohort profiled by RNA-sequence. Each boxplot represents the expression as fold change from RNA-seq data for the marker genes of the four different subtypes in TCGA-cohort of GBM patients (155) identified by the 121 isoform classifier. The y-axis for MET is shown in logarithmic scall. All fold changes were calculated relative to normal brain tissue and statistical significance was determined by two sample t-test.
Figure 12:
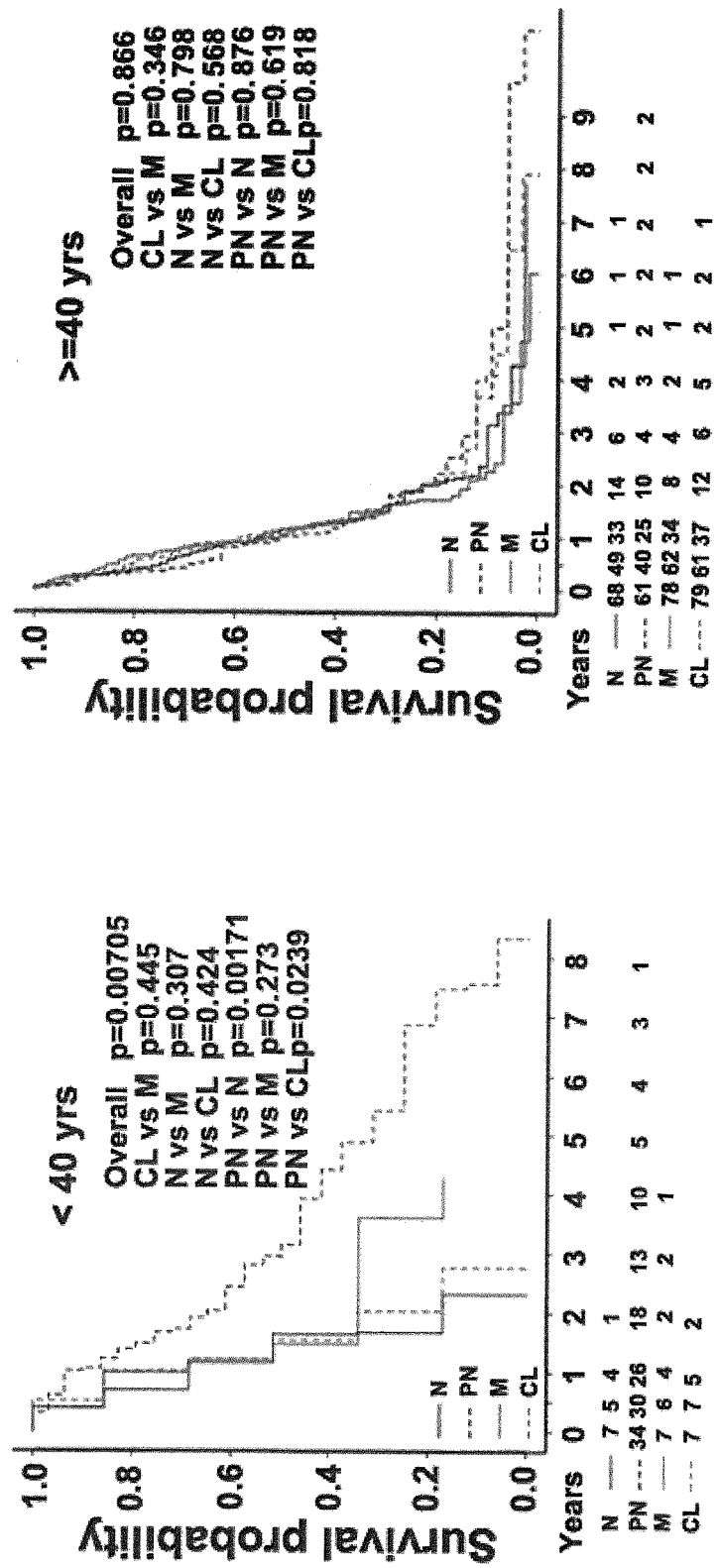
FIG. 12 are two survival plots (left panel and right panel) on the TCGA cohort segregated by age; left panel is patients less than 40 years of age; right panel is greater than or equal to 40 years of age.
Figure 13:
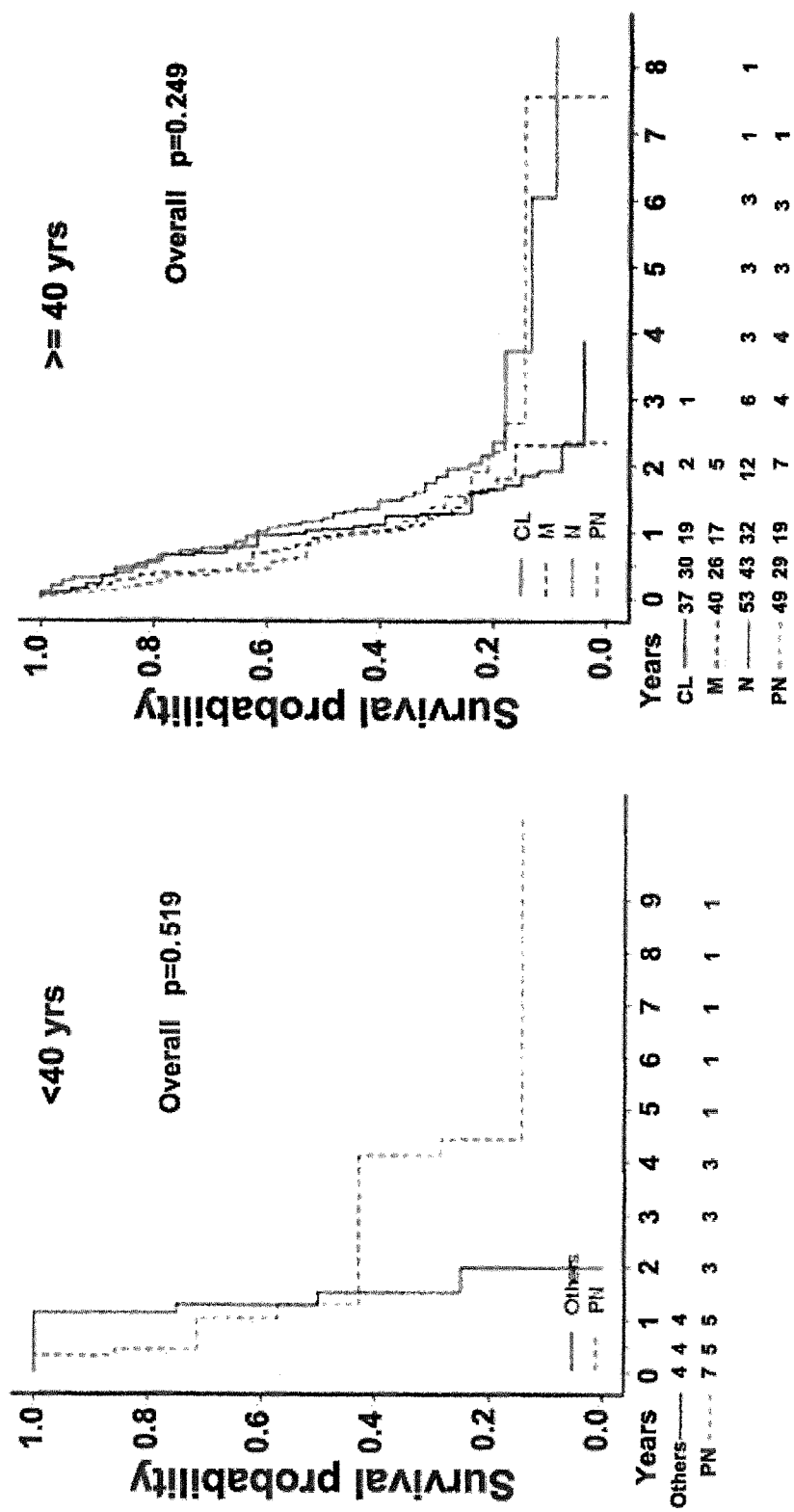
FIG. 13 are two survival plots on the Penn cohort segregated by age; left panel is patients less than 40 years of age; right panel is greater than or equal to 40 years of age.
Figure 14:
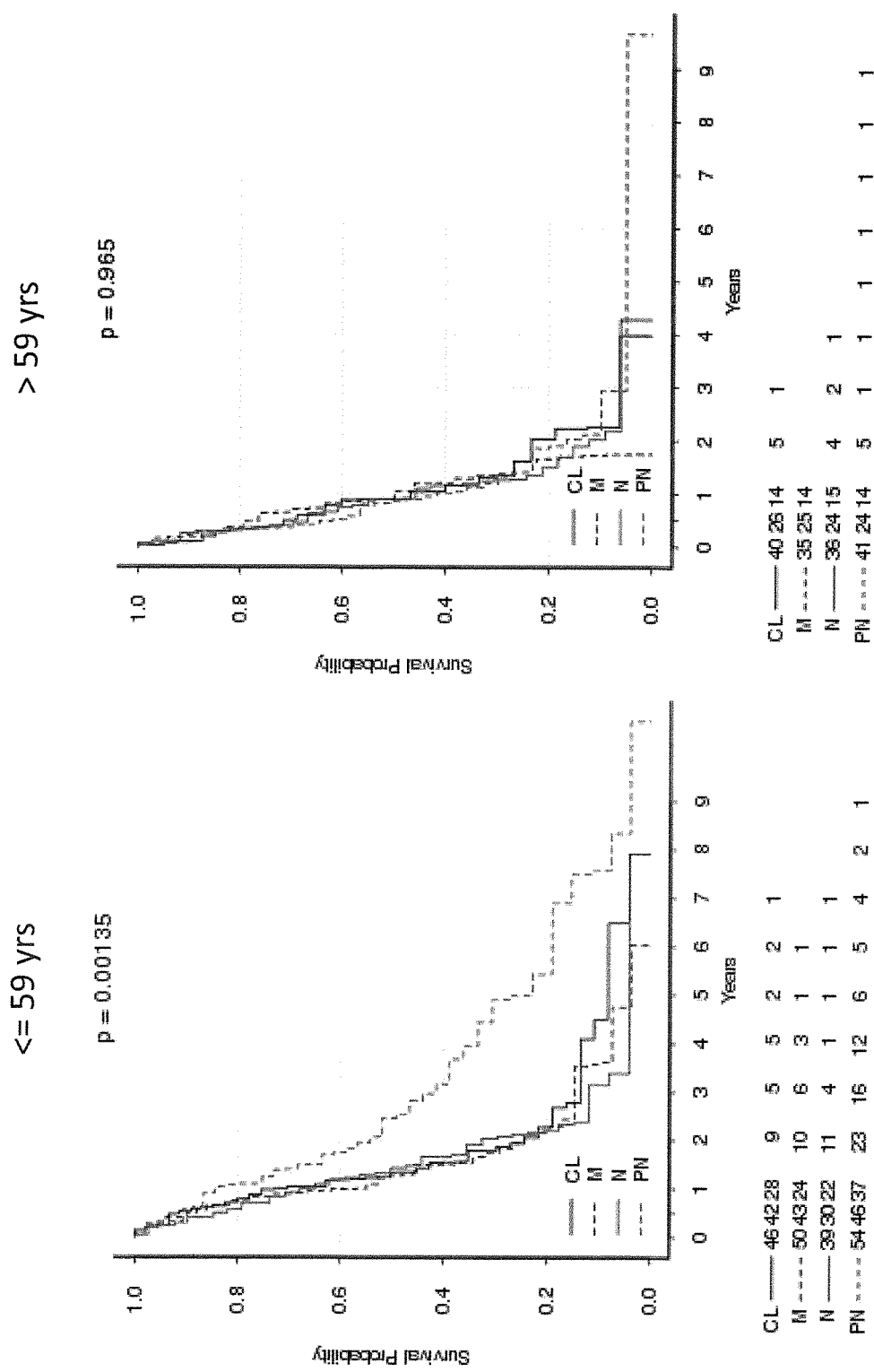
FIG. 14 are two survival probability graphs of TCGA samples separated by median age; left panel is less than or equal to 59 years of age; right panel is greater than 59 years of age.
Figure 15:
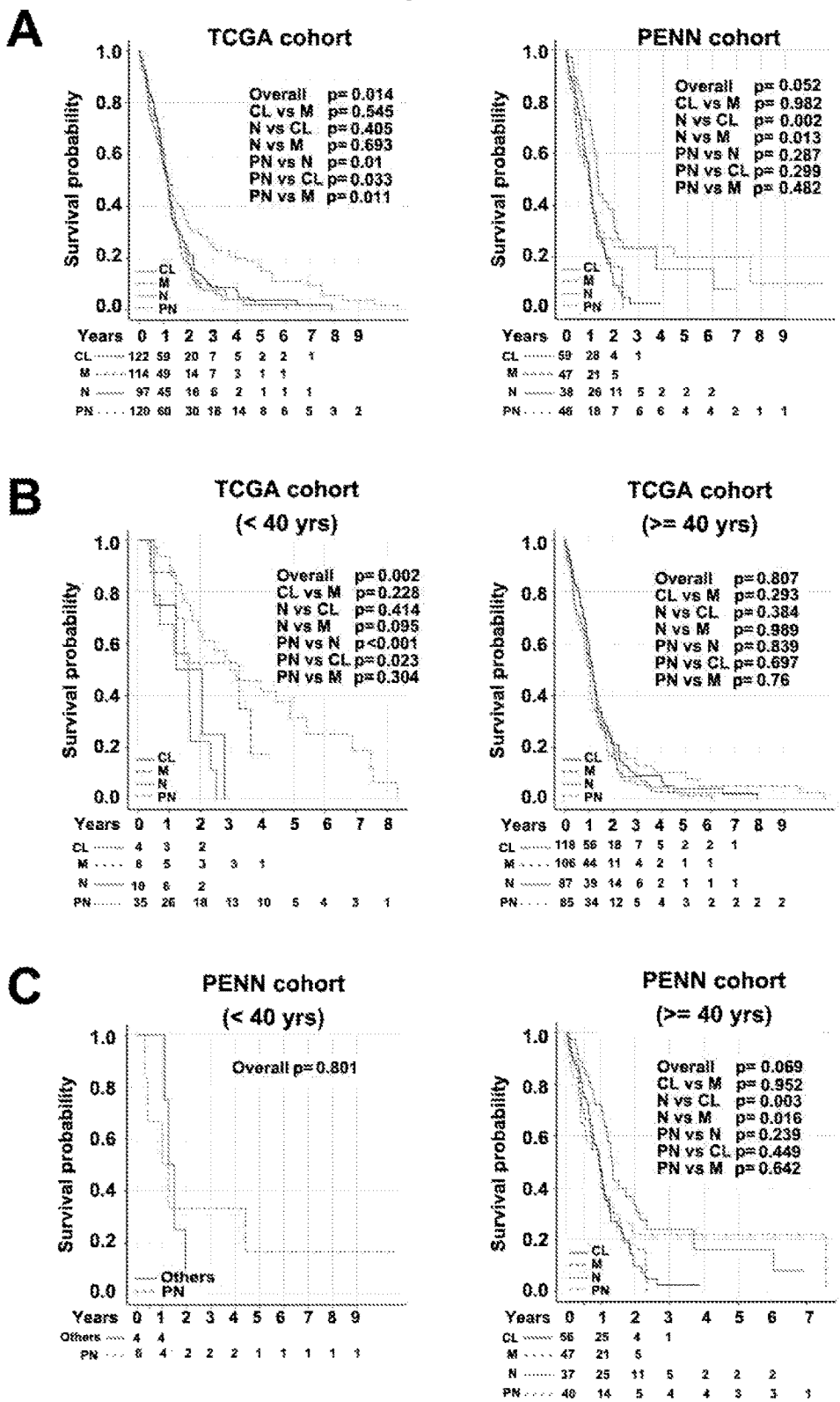
FIG. 15A consists of two updated Kaplan-Meier survival plots for TCGA cohort (left) and Penn cohort (right) of GBM patients with the overall survival curve for GBM patients who were classified into four subtypes by the 121 isoform classifier based on the RT-qPCR expression estimates. The statistical significance of each plot is indicated. These plots were generated using the updated Platform-independent isoform-level gene expression based classification system (PIGExClass).
FIG. 15B consists of two updated Kaplan-Meier survival plots for isoform-based core samples from TCGA cohort of GBM patients divided by age as <40 yrs (left) and ≥40 yrs (right) at time of diagnosis. The statistical significance of each plot is indicated. These plots were generated using the updated Platform-independent isoform-level gene expression based classification system (PIGExClass).
FIG. 15C consists of two Kaplan-Meier survival plots for isoform-based core samples from Penn cohort of GBM patients divided by age as <40 yrs (left) and ≥40 yrs (right) at time of diagnosis. The statistical significance of each plot is indicated. These plots were generated using the updated Platform-independent isoform-level gene expression based classification system (PIGExClass).

We applied the retrained classifier on the Penn-cohort to identify each patient's subtype. Our results indicate that 52 (25.2%), 41 (19.9%), 50 (24.2%), and 63 (30.5%) of patients belong to PN, N, M, and CL groups, respectively (Supplemental Table S7). We also observed that for 16 (~8%) samples, the difference in the top two probabilities for subtype assignment is less than 0.05%, which we defined as "low-confidence". However, for these samples our classifier can confidently eliminate the assignment to the other two subtypes. To address the issue of reproducibility, we independently re-isolated RNA and performed the RT-qPCR analysis on three patient samples and found good correlation (r~0.9) between the two datasets. Moreover, our PIGEx-Class based classification algorithm assigned the samples to the same subtype as before (Supplemental Table S7[46]). To further validate the assignment of subtypes, we looked at the expression of known markers for each subtype[1]. As expected, we observed higher expression of the neural marker-GABRA1, proneural marker-DCX, mesenchymal markers-CHI3L1 and MET, and classical marker-NES in samples belonging to the N, PN, M, and CL subtypes, respectively (FIG. 3D). Similar marker expression pattern was observed for the 155 GBM samples from TCGA that were subtyped based on RNA-seq data (FIG. 11). In conclusion, we have developed an RT-qPCR-based assay that can reproducibly predict the molecular subtype of GBM patients based on the relative expression of only 121 transcripts/isoforms in the tumor tissue.

B. Prognostic Significance of the Stratification in Younger and Older GBM Patients The molecular stratification of the TCGA-cohort's isoform based core samples by the isoform-based signature showed that the PN subgroup has significantly better overall survival than the other three groups (FIG. 2). We plotted the survival curves for the four predicted groups of the whole TCGA-cohort (both exon array and RNA-seq samples) and Penn-cohort after removing the samples with low confidence calls (FIG. 4A). To our surprise, we did not observe a better overall survival for the PN group in the Penn-cohort. Instead, we found that the neural group had a significantly better survival rate compared to the classical and mesenchymal subtypes (FIG. 4A). This result prompted us to investigate the characteristic differences between the two cohorts (Table 11). One striking difference was in the representation of younger patients (age<40 years at diagnosis) between the two cohorts (10); while 12.1% in TCGA-cohort were younger, only 5.8% were younger in the Penn-cohort. We found that most of the younger patients—in the TCGA-cohort were classified as PN (35/57), and these patients had a much longer survival compared to the older PN patients (Table 11 and FIG. 4B). Hence, we decided to re-plot the survival curves for the TCGA and Penn cohorts separately for younger (<40 years) and older patients (40 years) (FIG. 4B, C). Our results clearly demonstrate that the prognostic significance of the PN group in terms of survival is valid only for the younger patients, and among the older patients, the PN group has the poorest six-month survival rate in both the TCGA and Penn cohorts (Table 11).

Based on the results described above, our study agrees with the general consensus that patients who are young and have a PN subtype tend to have better prognoses[11]. We also found that among the older patients, the PN subtype confers a poorer prognosis.

TABLE 11

Updated Distribution of GBM patients in TCGA and Penn cohorts based on age and molecular subtype (earlier analysis in Tables 5, 6, 8).

| Distribution of GBM patients by age | | | | | | | | | |
|---|---|---|---|---|---|---|---|---|---|
| | TCGA sales | | | | | Penn samples | | | |
| | Age group (yrs) | | | | | | | | |
| | <40 | 40-50 | 51-60 | 61-70 | >70 | <40 | 40-50 | 51-60 | 61-70 | >70 |
| Patient (%) | 12.1 | 13.1 | 26.5 | 27.3 | 20.8 | 5.78 | 18.42 | 25.78 | 25.78 | 22.1 |

| Distribution of young and older GBM patients among the four subtypes | | | | | | | | |
|---|---|---|---|---|---|---|---|---|
| | | TCGA samples | | | | Penn samples | | | |
| | | PN | N | CL | M | PN | N | CL | M |
| Overall | | 121 | 99 | 123 | 114 | 46 | 38 | 59 | 47 |
| Age < 40 yrs | | 35 | 10 | 4 | 8 | 6 | 1 | 3 | 0 |
| Gender | Male | 14 | 5 | 0 | 2 | 4 | 1 | 1 | 0 |
| | Female | 21 | 5 | 4 | 6 | 2 | 0 | 2 | 0 |
| Age > 40 yrs | | 86 | 89 | 119 | 106 | 40 | 37 | 56 | 47 |
| Gender | Male | 58 | 61 | 71 | 68 | 29 | 17 | 29 | 32 |
| | Female | 28 | 28 | 48 | 38 | 11 | 20 | 27 | 15 |

| Survival for the older (>40 yrs) GBM patients among the four subtypes | | | | | | |
|---|---|---|---|---|---|---|
| | TCGA-cohort (%) | | | Penn-cohort (%) | | |
| | Survival (months) | | | | | |
| | 6 | 12 | 24 | 6 | 12 | 24 |
| N | 63.2 | 44.8 | 16 | 83.8 | 67.5 | 29.7 |
| PN | 63.5 | 40 | 14.1 | 65 | 35 | 12.5 |
| M | 67.9 | 41.5 | 10.3 | 70.2 | 44.6 | 10.6 |
| CL | 71.1 | 47.4 | 15.2 | 76.7 | 44.6 | 7.1 |

Each and every patent, patent application, and publication, including publications listed below, each publically available nucleotide, oligonucleotide and protein sequences cited throughout the disclosure, U.S. Provisional Patent Application No. 61/808,878, filed Apr. 5, 2013; U.S. Provisional Patent Application No. 61/937,215, filed Feb. 7, 2014; and Pal et al., "Isoform-Level Gene Signature Improves Prognostic Stratification and Accurately Classifies Glioblastoma Subtypes", Nucl. Acids Res., e-publication: Feb. 6, 2014 are expressly incorporated herein by reference in its entirety. Embodiments and variations of this invention other than those specifically disclosed above may be devised by others skilled in the art without departing from the true spirit and scope of the invention. The appended claims include such embodiments and equivalent variations.

REFERENCES

1. Dunn G P, Rinne M L, Wykosky J, et al. Emerging insights into the molecular and cellular basis of glioblastoma. Genes & development 2012; 26:756-84.
2. Vitucci M, Hayes D N, Miller C R. Gene expression profiling of gliomas: merging genomic and histopathological classification for personalised therapy. British journal of cancer 2011; 104:545-53.
3. Verhaak R G, Hoadley K A, Purdom E, et al. Integrated genomic analysis identifies clinically relevant subtypes of glioblastoma characterized by abnormalities in PDGFRA, IDH1, EGFR, and NF1. Cancer cell 2010; 17:98-110.
4. Li A, Walling J, Ahn S, et al. Unsupervised analysis of transcriptomic profiles reveals six glioma subtypes. Cancer research 2009; 69:2091-9.
5. Olson S, Berger A C. Genome-Based Diagnostics: Clarifying Pathways to Clinical Use: Workshop Summary; 2012.
6. Grabowski P. Alternative splicing takes shape during neuronal development. Current opinion in genetics & development 2011; 21:388-94.
7. Pal S, Gupta R, Davuluri R V. Alternative transcription and alternative splicing in cancer. Pharmacol Ther 2012.
8. Bemmo A, Dias C, Rose A A, Russo C, Siegel P, Majewski J. Exon-level transcriptome profiling in murine breast cancer reveals splicing changes specific to tumors with different metastatic abilities. PLoS One 2010; 5:e11981.
9. Boidot R, Vegran F, Lizard-Nacol S. Predictive value of survivin alternative transcript expression in locally advanced breast cancer patients treated with neoadjuvant chemotherapy. Int J Mol Med 2009; 23:285-91.
10. Lapuk A, Marr H, Jakkula L, et al. Exon-level microarray analyses identify alternative splicing programs in breast cancer. Mol Cancer Res 2010; 8:961-74.
11. Misquitta-Ali C M, Cheng E, O'Hanlon D, et al. Global profiling and molecular characterization of alternative splicing events misregulated in lung cancer. Mol Cell Biol 2011; 31:138-50.
12. Wang L, Lawrence M S, Wan Y, et al. SF3B1 and other novel cancer genes in chronic lymphocytic leukemia. The New England journal of medicine 2011; 365:2497-506.
13. Ebert B, Bernard O A. Mutations in RNA splicing machinery in human cancers. New Engl. J. Med. 2011; 365:2534-5.

14. Friboulet L, Olaussen K A, Pignon J P, et al. ERCC1 isoform expression and DNA repair in non-small-cell lung cancer. The New England journal of medicine 2013; 368:1101-10.
15. Turro E, Lewin A, Rose A, Dallman M J, Richardson S. MMBGX: a method for estimating expression at the isoform level and detecting differential splicing using whole-transcript Affymetrix arrays. Nucleic acids research 2010; 38:e4.
16. Workman C, Jensen L J, Jarmer H, et al. A new non-linear normalization method for reducing variability in DNA microarray experiments. Genome biology 2002; 3:research0048.
17. Smyth G K. Linear models and empirical bayes methods for assessing differential expression in microarray experiments. Statistical applications in genetics and molecular biology 2004; 3:Article3.
18. Brunet J P, Tamayo P, Golub T R, Mesirov J P. Metagenes and molecular pattern discovery using matrix factorization. Proceedings of the National Academy of Sciences of the United States of America 2004; 101:4164-9.
19. Gaujoux R, Seoighe C. A flexible R package for non-negative matrix factorization. BMC bioinformatics 2010; 11:367.
20. Diaz-Uriarte R, Alvarez de Andres S. Gene selection and classification of microarray data using random forest. BMC bioinformatics 2006; 7:3.
21. Breiman L. Random Forests. Machine Learning 2001; 45:5-32.
22. Rousseeuw P J. Silhouettes—a Graphical Aid to the Interpretation and Validation of Cluster-Analysis. J Comput Appl Math 1987; 20:53-65.
23. Liu H, Hussain F, Tan C L, Dash M. Discretization: An enabling technique. Data Min Knowl Disc 2002; 6:393-423.
24. Brennan C, Momota H, Hambardzumyan D, et al. Glioblastoma subclasses can be defined by activity among signal transduction pathways and associated genomic alterations. PloS one 2009; 4:e7752.
25. Lu K V, Chang J P, Parachoniak C A, et al. VEGF inhibits tumor cell invasion and mesenchymal transition through a MET/VEGFR2 complex. Cancer cell 2012; 22:21-35.
26. Therneau T M, Grambsch P M. Modeling survival data: extending the Cox model. New York: Springer; 2000.
27. Siker M L, Wang M, Porter K, et al. Age as an independent prognostic factor in patients with glioblastoma: a Radiation Therapy Oncology Group and American College of Surgeons National Cancer Data Base comparison. Journal of neuro-oncology 2011; 104:351-6.
28. Lee Y, Scheck A C, Cloughesy T F, et al. Gene expression analysis of glioblastomas identifies the major molecular basis for the prognostic benefit of younger age. BMC medical genomics 2008; 1:52.
29. Feero W G, Guttmacher A E, Collins F S. Genomic medicine—an updated primer. The New England journal of medicine 2010; 362:2001-11.
30. Poulikakos P I, Persaud Y, Janakiraman M, et al. RAF inhibitor resistance is mediated by dimerization of aberrantly spliced BRAF(V600E). Nature 2011; 480:387-90.
31. McDermott U, Downing J R, Stratton M R. Genomics and the continuum of cancer care. The New England journal of medicine 2011; 364:340-50.
32. Pal S, Gupta R, Kim H, et al. Alternative transcription exceeds alternative splicing in generating the transcriptome diversity of cerebellar development. Genome Res 2011; 21:1260-72.
33. Phillips H S, Kharbanda S, Chen R, et al. Molecular subclasses of high-grade glioma predict prognosis, delineate a pattern of disease progression, and resemble stages in neurogenesis. Cancer cell 2006; 9:157-73.
34. Shen R, Mo Q, Schultz N, et al. Integrative subtype discovery in glioblastoma using iCluster. PloS one 2012; 7:e35236.
35. Sturm D, Witt H, Hovestadt V, et al. Hotspot mutations in H3F3A and IDH1 define distinct epigenetic and biological subgroups of glioblastoma. Cancer cell 2012; 22:425-37.
36. Liang Y, Diehn M, Watson N, et al. Gene expression profiling reveals molecularly and clinically distinct subtypes of glioblastoma multiforme. Proceedings of the National Academy of Sciences of the United States of America 2005; 102:5814-9.
37. Shirahata M, Iwao-Koizumi K, Saito S, et al. Gene expression-based molecular diagnostic system for malignant gliomas is superior to histological diagnosis. Clinical cancer research: an official journal of the American Association for Cancer Research 2007; 13:7341-56.
38. Yan H, Parsons D W, Jin G, et al. IDH1 and IDH2 mutations in gliomas. The New England journal of medicine 2009; 360:765-73.
39. Check Hayden E. Human genome at ten: Life is complicated. Nature 2010; 464:664-7.
40. Tanaka S, Louis D N, Curry W T, Batchelor T T, Dietrich J. Diagnostic and therapeutic avenues for glioblastoma: no longer a dead end? Nature reviews Clinical oncology 2013; 10:14-26.
41. Warnat P, Eils R, Brors B. Cross-platform analysis of cancer microarray data improves gene expression based classification of phenotypes. BMC bioinformatics 2005; 6:265.
42. V C, Roberts A, Goff L, et al. Differential gene and transcript expression analysis of RNA-seq experiments with TopHat and Cufflinks. Nature protocols 2012; 7:562-78.
43. Manilich, E. A., Ozsoyoglu, Z. M., Trubachev, V. and Radivoyevitch, T. (2011) Classification of large microarray datasets using fast random forest construction. *Journal of bioinformatics and computational biology*, 9, 251-267.
44. Datta, S. (2008) Classification of breast cancer versus normal samples from mass spectrometry profiles using linear discriminant analysis of important features selected by random forest. *Statistical applications in genetics and molecular biology*, 7, Article7.
45. Riddick, G. and Fine, H. A. (2011) Integration and analysis of genome-scale data from gliomas. *Nature reviews. Neurology*, 7, 439-450.
46. Pal et al., (2014) "Isoform-Level Gene Signature Improves Prognostic Stratification and Accurately Classifies Glioblastoma Subtypes", *Nucl. Acids Res.*, 1-11, e-publication: Feb. 6, 2014.
47. Zhang, Z., Pal, S., Bi, Y, Tchou, J. and Davuluri, R. V. et al. (Apr. 17, 2013) Isoform-level expression profiles provide better cancer signatures than gene level expression profiles, *Genome Med.*, 5:33.

SEQUENCE LISTING (231 sequences)

SEQ ID NO: 1 - DNA, 37300 bp, Homo sapiens
agcccgcggagctgagcggcggcggcggcggcggcaggagcccgggaggcggaggcgggaggcggcggcggcgcgcggagacgcagcagcggcagcggcagcatgtcggccggcggagcgtcagtcccgccgcccccgaaccccgccgtgtccttcccgccgccccggggtcaccctgcccgccggccccgacatcctgcggacctactcgggcgccttcgtctgcctggagattgtaagtggggccgccggagcgagggtcgcgcggggagcgaggacaggcggcggcatccttgtcccccgggctgtcttcctctgcgtccgcccccggcctccttcccttcgacgtggctttgtcctgcgctccctcccggggtcctctcggtgccccgcgccgccgcccgggccctccctcctagcacctgttacgcgggcacctgctcccccgcgggcgacggaaattgcctggggagggcgagtaggcggcccggcagggccgaacattggggacgtggaggaaagaaaggtgttggggctcagaggcgcctttagaaacccagggcatggccaggggccgcgcttggccggagcgagctcctggctctcggcctcgcctgttgctaacctgccattttgttgggtggtgcaaaggtgtagccgatgactgggtgacctggtggctgccacgctgtggaaagtgggggcgggaggcaacaggaagaggaagagggctgaggacttgaacatgctttttccccactcacccttgccatcattagtggcctttggattggaaagaggagctgggcaggaggcagggcaaggagaaaggtgagttatgtgccatgccctgggcagtttctaatccagtgggtgtgacaatggtgggggaaagatggaaacgtggctctcgagttcttctctgcctgcctttgcaccttctcacttcctggcctccttacgcaactccaaacctttttagcacactttgttgggcccaagtaaaggtggggttacctgcctgtcgtgcagcctttttaggtagcacttgaactttttaaatggaattttatggagttggaaactttcgaagctccttgtggacaagtagataatgtgcaaatataaattgggcaacctgaggttgcatcatgcctgagaatggcaaataaaaagtgaaatgttagcgagttagtgcctttccggcaggctggtattgtttgctcggtttaggattttcatctctcccctcaccctggcctttgagcttgcataacctttatttgggtcgctttggtttcacttttgtgcttgtggagctggatcaccttgtgagcactgttctattatgctcaggtagccacaccaccctaagttaagtttagcccggatttgaatctgaaagaggagacgtgagtgagttgcaggctatgacatcagtaatgggatcctgactgcgaggctggtttgagtttgagcctggttcagaagcatctgagtgcttgggatgaggtgcaggcatccatgtgggaagagcggagagacgatggcattgggctggctgccttgctgtgggagggagacacgtttagaactggaagatctgcaaagaacgatttcttaggttctcggctactttattccatgttctgcaagctccagttttttgcctacctctttgagaagtttttgccatatccgcattccacctgtactagaatttacagacagttcattgaaatactttctaaacttcagtacttttgtcttttcttaagcaataatatacatgaaatttcaaatttgatattctggttatatttttctaatgtttattcaaatatatgtatgtatgtatgtaaagatacatgtatgtgtatatgtaaatatatatacatgtgtatatgcaaagaaggcttatccatatgccctctaatcaaataccatctcaagaacctgtagtcatgtcagacttttaggaaacaaggcctaattctgggggaaaagaatagaaagtgacttagtcaatttccccctccccctccccattatatcttttttaaatctagcccagaggttagttctcaattcttgctgtacttaataacttgaacagctttttaaaataactgttaccagcccagactaattaaatcagaatctctgggggagtgccagagttcactagttattttttaaagcttccctggtgattctaatattcagagcctagagaagacagctctgctttcagagatgtgaattctctctatccgctaaaactgccaccactccccaacctaggagggattccagactcacagaagtgtccaatctaatcctcttatctcatttcctctggcttcttacatcctgaaacatgtctcacactcttggctacgtagaacagcatcacttccaaaagcttattagtttgcttctctctttttatggccaactcaataagtttacattttaggccccctttatctcctttacttgaatatcaatctcccccaccccattgaaaaatgaccaaaatgttccaatgaaactggtgacgttagagaaacaaaacaagagaccacactagagtcaaactatagctcctcggctctcatcctttaggactgtttagagatattggtttacatgctttaagagagcagagatcaaagctggcttgttacccctccatttagaatactcatcttgagtggatgtacagatagaagctaagtgaacacttttgaagcaacttagctcctagatgtctcaatttccatctaattttctgattcttttaaaattggccatctcccatggctcctcctcagaaattcctcaacctgtaaagtaaatgtgagaatttcccaggcactgtcctaaatgctaagtgatctccattctggggacccattattttaacctctgccggtgtttctggatatcctcaaactccattttaattttgaccttctgttcaaattcgtttgtctttaagagttcttcatttctgtcccattgccttctgaaacttaacatgtgaaaattgtacctgacaaaggaggactgggctatcaacagttgactacgctattgacaccatgctcttggagtttggttctcacactaaccatttaacttggctcaaagtattcattcccaattccccttaacgtattctattcacagcctgtcagatataagccatttgttgggagatattacaaaatatataaatagtgccagcctacgagcaccaggaaaagcattatagcactggcttcttaagtggagaatattacaatctcacgtgcatagtgatttttttttttttttttttgagatagggagataaggtgtgttccactcctggatacctaattgtcagctctttggttttgggcttagcaatacttaccaatgtatgcttgccacagagtttaatactaagttaatattgcaaagctaagccttttagcttagaatggaagccatcaccttcaaaattcgcactttcaaaatctcacagttttttgagtgaatattttataaaaatcactcatcgggtatttactgaatacctactatgtgcaaggcactcctctgggaacaaagatgtttaaacccttcctcaccagaaagacctataacctagttgagagtatagtcacaaaagtaactaccattcagggaagaaagaattaagtatgggaagtgaactgcagctaaaacattttccaggtgggtctatctactttaaaaaataacatgggatcatctgcactattgggctgaacaagatatttaggatccctgctctcaatgagcttatcttgtaaaatgcacaagaaaaattgaatttttaatagtattaatcacgaaaaagaatacagataatcattgaattcattgtgttttattttgcagttttagtgtttaagaaactacttatattccccaagttattcattcacatttatctttgtgggagatactctaggattcttattcacatgcttctaactgcagtgttttggatgccatagtaattttcatttactcagcttataattaagaacatactatgcatcaagccttcttttatgccctgaaaatagagtaactaacatggctcctgcccttaaaagaaattactgtttggtggaatataaagtcaagaaagaattaccatgctgtgtatgaagtgctaatataggtttataaaaagtattgtggaacagcaggatagagtacatctgacttctggagaggtcagaacaggcagctttaatgaggtggggacatttgaggttagccttcaataatgagccatggttcattagaaaatgggaaagagaattccaggtagaaacaaggacacgtacaaacacagagacaagaaggacaatggcaagaacgttctgtcagttgtgagattttggtgggccgtggcagaaaaaggaaaaacagcaggtaggactcaggttctggtttgctgagaaatgctaggccaaggcattggatttattgtctgatggaaagctgtgaaggacagagagaaacttgatccagcttgtgtcttagaaacctttgagtgatgaagtttggttgtaaaacaaagggactgaaggcaggaagagcagttagggggcttattgcaatagtttagataagggatgaaaagaacctgaaatagaaccaatgaaagaaggatggagaaggagagagagaggtttgaggtttgggaagtcaattaagtatgtaaagtttgacttgccccaaagtgatacctagactaaacttaaatataagatgtaactcagaggaattatgccagaaaaacaaatgttaatgaaaggatgattgtgagggagggactttaggggaggcaggttcagtcatgcagataaatctatgaaagggacttcaggttattttcaactgagagctttgactttggactagtaacatgtatatgttctgatgtatagagtttattgcctggaaaatgttgactgtgaagggacattgcttatttgcagtgtgcaagagggagctgtccatggacatagttgtcccctaaatgggttttaaaactgtaggtattttttttcctttgcctctggattaaaaatcttcatccacattaaaagaatctttaggccgggtgcagtggctcatgcctgtaatcctagcactttgggaggctgaagcaggtggatcacctgaggtcaggagttcaagaccagcctgaccaacatggtgaaacccccatctctactaaaaatacaaaattagccaggtgtggtggcacatgactgtaatcccagctacttgggaggccgtggcaggagaattgcttgaacctgggaggcagagttgcagtgagccaagatcgcaccatcaccctccagcctgggaaataagagcgaaactacatccccaaaataataaatgaataaataaataacctttaaagtttcataagggaaaataaaccaatgcccctgccagagattattatcaacaatcatttgctccgactggcagtcctttaaaaaaaaatacgaagaactgaaatatggaaaactttaaaccaagtagctgaaaagattcaccttgagctccaaaggaaaaagtcatagagaagagatttgttttgtagagcctgatagaaatgttgtacgtggtggtaggagctgtggacatggtgtatttgcagtgatatggctgaatagaaatgaccctgtaatgacaaaggacaggaaccaggttggcatacccagtatcatgcacatgcagtacttaacaaatgctacttgtttgttctatagtacaaactgagcagtatgtgaaaatagtctggagacattggctggagtggagaagggcagcttgggagtagatgccctcttaaatcttgcccaacatgtaaactgccataattcttctccaggtttctgcactttaacttgaatttcctaagtgttctattttatataagagtaccatatccttttatagacaacatatataacaatctcaacttctgtataatagctatgagaaggaggaaggtaaaaagaaaggaaagaggcagtgatttatacgggtctggccaatatcagggcattggcacgcaggaacagctttaaactaaaagtgataactagttacctgcaaacatgaaaagggaattttcaaaatcgagaggaattattataaagaagaataaaaagaaccagaacatatttctcctctgtaatatgagctttccattttagggtcggtgtcagctatttaagcagctgaattggaggtttaggtcacatggggaggaagaaagtataactctctatagcactctcagacatatttttaaagccttcaaatgtaaagctaaaaagtagaacttcttttgcaatgagtattaacgtattttggtcataagcctcttatgtgtatgtcatttctcattacatcccagaatttgttctgttttcctaactaactaaataaataaacaccttgctgccttgcatctctaatgcaggtctatgccagggccagtccagaagcagtttggacagaagtcagcatggttagaggacagatggggactgatgaggggagcaggaggcactggaagaaggcacaagatttaccctggtcaaaagttccagtggcagttacaatagaaataggtcatgtgggcaaatttggggccgaaaaaagatttaaaattgggtgtcatgaattcaactggcaagaggtacaaagtttcccataactttccatctcagcctcctgagatctggtactaggtggtgggtgtcaccaataataacttgagaattgagaagtacatattctcgcttcactcgttttcatgcctatttttggacatccaccatgaaccagggagtgagctgggctccagaccggagtgtgttcctagcatcccaagctgcactcctagagcattctcttttggaaccattcattacacatgccggttggtttccattcatttcaaggaggatggattgaggaccttctgtagaaagcaccaccctgggtaatgagcatacggagatgttgaaggcaatgtcaccgactctgacgtcacagtctagtgggtgaaatgggcatgtagatccatgattttgatccagttgtaattgctgtggagaatacacgcgtcagtaaccgtggaagcaccgagggatggcacctggccagggaagtctttctggaaaacatggtaactggagtttagttatgcagcagaatttttactggcagcatgctaggcagaaacatggtcaagtgtgatcatttctctatgctcaggggatgaggggtagaggctggaatgcaaagagagggtggtaggaaaagaagcattacagggaagatgatgagcttggggaggggggcagcagtatgccttgtagtggtaccagtgatctacagtcgcattgtgaatgaatccatacttgtgtgggctgctttgtaaatacatctaccagttatattgtatgtgttggctaagtatgtttctagtttaaggaaatctttcaaaatgcgaattgtatgtaaaatatagctaattgtagataatctttttttttctagctgataaatttctgaatatactgaacacttctataaccatgatgtttcctgtgcagcaccccataagtaaacatccattaaaatagaaggggttacaagtagataaagtgttctgaacttctgggtgggggggccacatacccctttgtgattctgatgaaaggtgtggactgtgtcctcagaaaaatgcatatgtacttgtccacccaattttatatgattttaggaaatcatatggaatatgggtagaaaccctgctttagaatgaacactaaaccatgagaggggcagaatagcagaatgttaaaatcataagttctggaagccaattgccaagttcaaatttcaggtctaacacttattaactatataactaggaacaagttatgaatggatttgtacctcaattaacttacctataaagtaggaataataatgttgtctctcaaggtctgtgaggattaaattggcacaaataaaacccttataacggtgcttataacataagagctcagtaaatgttaagtactatttctgctatcaccattagcttcaacttcttactctaactctacaagccagactggaagacaaatatttttttgcttttcctctatgtttgctgggtgttcattctcactgcagtagaataatgaattatccaatatatagataatagaattagaaggagggagcttaatacggaaagttctaaatagtgttttcccttatgggtagtttagccagcctttatcctttcaaattcacttaccttttcctgttctcattccaaacattaattgaaaataggtcacagtagaaattagccggtttactttgtgggtatactaagatggaggtgtcaaattggtttgaaaaaatttttagctgtcagagggtatgtttaaaagcaggtaattaggaaataagtgacatttgaaaagaaaaagggcatttgcaaaaggaaccctttgggaacataagaccgtccaaacaggagatgagttaagaatctgtaattcatgcacccagaattgcaagagttgctacttgctcaagagcatgttttcccgtgggactatgtatttttcccattccacagtttctagtgaaaacatgtcttcacatcaaaccctgaggattcagtttagtgtgatttgtggataaatacttccgtggttttcttatggtagggtttcagccaagtcatacctttctggtctgcagagaccaagcaaacataacaaacatgtgttaaaccagaaagaagatcagttgttttaggaatgtgtagcaatttaataactgcaactcagaatatatttgagtacttctggtatgtacccagtacacctaaagttgggttaagaagataaaaggtgactgagtcaccgggagatgctgatacctactcctaggaggtttttacctttgtattgcctggaagcaaaggtagtctttttgttagagcttgaggtttgacgtcataagcactgacttagtttcttaaagaaatttcaaattgaggtgcctttggctattttatacataattattggattttttagaacactagaaagcagtggaaggcagtggcagggaaggggtcagaatatggattcagatccaagacgatgagaataacgtgggcgaaacatataatagttccgaatacctttcttcacagtgtgtactctgcagttgctactgtatttatcatctgttctctgtcagatttaaccatttttgtgttctgctttttacttctaaaaatatggccacctccagagtcgtctctactgaacaggaatgctgataattacaccgttttgcaaacactctaagctcactaatgcccggaattagaggaagtgaatatactgagcattggtcatctcaattttttaagttcagttttttaacttaaaaaaactggagccaagtttaagttggagccaagttgggaagctcaagaagaaaagtagcttttgtcaaaaggaaatcacaaagtagggaataataactgtgtcaaggccagagtgatccatacaccagtatgacagtctcaaaatgaggatggtggccctccaaagtgggctcaattatgttctctggcccatcctctctcttccaaagcgagcctggatttcacagaatctcagctctagggatgtatcatatgtatttacttgagtgagagagagggggcattcctacactccttccctctcccctttccatgcagcacataccccacaagtgaggaggtgaatctgactcctgttcatgcagcatttagtttcccttccaagcctttgaggtgtttgaagggctgtaattttgagtacgataagaacggttagtctatactattttacagtatagcctctgctgtcaaagccttggtctgtcttgaaagcttactctgaagcctgcctcccctgcctacctttccagattcttcccattatatttcttctctcctctcccctcccagcctctcagaacacactgtgttgagctctttttatagcacccaccgcaatctgctcctgaatcagtttaatagtgtctatttcttccttatttcaagctcctggagatggaaccttgccttttttgttttttcttgagtgttcttctatagtacctagcagtaggttcggggctggcctgtttgaggtccagtctgggtttagtaaatgctgtgttgaattccaaaggatcatatagcctcctctttagaggtgtgaatgtatcatcatccctaactcattatgtttatctatttggctctgcctgtccctaacaaacagtggccaattgctttttattatcctttatatttgcacataggttctcaggaaataactcagaagagatacttaatgtatatttcttaaactgtatttaaagttatgtaggttattctttgtgggagagtaagaaaagactaccagaaagaagaaagtggaaaaaaaggaaagattgatccactgaagacatacttatatcgccttcagatatttatttaatagtatgtaaaggtaaataatattaggaacaagttttttcttttataggcactgataaggtggtggttaaatgtttaagatgcactgatattcattagatttatttcataacactttctggatcaattgttaattttttatttgactttaggagttgaggtatacaccacaactatacatttttttagactggtgatttgattatcattgatcaagtgatcatttatgctttcaaaaatgtttcttcaaagtagtaacaaattatatgattgggccttttcttgaagcttgaattaaaacttgtgtttttaactttcagtgacttgtggagtaatttggatatctagatactgaaatgcaatgtacagatgagtattgatttttaatatttggagctccaactgttctcacatgagcactagcttgtttactaagcaaataatttaagagcgtgctctatcactctccctgggtgtgtgtgtgtgtgtgtgtgtgtgtgtgtgtgtgagagagagagacagagagagagagagagagattgattctcacttgcttgaggtgtcttcagggcaggtatgtagcctaaggttttgtgctgccaaatctagcatagtacctgactgatggttaggaaaggattactgtgtagattaataaatggcttgggatgcagagacatataaagcagtatgctgccaagaaggcctggtagtgcagatggagagccaaagggatttaattacagtgtatctcactgatgtaacaaagcccagtagggaggttgcccagaggagggaggcataactgagcaggggtggatctcaggaaaaatgttgtaaatgatgtgctcaagattagatgtgagtgggagaatctcaagtacacatagggagggaatgacattcacggcatgcaagtaacaggccactctgatgtgaaagatctttgtcttggaactgtggattttttttctccccctaatacaaaatgtgaggggcatagtggcaagagacaaggatgaaaaagacatgtcagatcacaaatggcttggaatgccaggcatggtagtatggaggagaccaatggtgatagatgcataaaactcatcttcacaccatttctcctgcggtgttctctcaagcctagaggcccattccagaaatctgggtattttccttatctgtcctttttctgttgtgtcccacatctgatcagttaccaactattatcatgtctacttctaaatttcactctaatccattcctttctctctgtcctcagtgttctgattcttacactctgttggtctaacagtctcctgtgttacccaatgtttgtgaaatctctgtgttgatagagctgagaaacacagagatgtgctgcctcaccatccaccctttcctccccagtccattctcacattctagccagagagaaatttctaaaggcaaatcttgaccatgctagtttctgctcaagatgatcttggctttgtcatcgcccttaggtgaagttcagttccttggcccgagcttcagcacctcctcgctcagtctccagtacagttctctccgttccccaccagcacatgcccctcctgtcttgctgagctttgttcttcacctatgcggggctactctcagctcctgccatggaacccccctttcctccctctgctttaccccatagccctgtgctttggattgttgcttctaggaagtattttcaaatctggatttatagcccttgctgtgtggacctgcagtgcccagtatttgcccaattgtgacatttatgaagcagctttttaatcgcttgcttacttgtctctttcctctaatagactgtgagttctgtggtgacagaaaccaagtgtaacctgtttaccatttgattcccagcacctggcatagtgcctgaaatgtagtaggtatttattgatacttagatccatagatatgtgaagtacttattcctatgtcgaacacataatactcaataaatgatggtagtttttattgtttaccgccatatacaacagctgcaactattattctatccattttttttactaactctctaagaagcaatgagatcaaaagctggtttatagtgatgtgaagagcaacttcaaggagaggaattggagaccaagcaaagatgaatttgttaaaatggttgactgaaaaaataccttcattgaaaaggtggtagtcagagaatcagtaaagtcaaaggaaggtatttgtcaatgatgaaggaatactggacatgtacatgggttgaagaagcgagtccaacctgaagatacaggtgtggagttggatcagttctccaagcaggaggattgatcttgcacctgaggaaagaaggcatcttacataataaggggaaaatcgaagggatggggttgctggaatatgtgcaggggtctgggaggaaaatgaaggcaatgctgagggtaatacaagcatgtttaattctgttgtgtgaaaggtatcttttaagcaaaccaattaccctctttttctctttcagctgttcgggggtcttgtctggattttggttgcctcctccaatgttcctctacctctactacaaggatgggtcatgtttgtgtccgtgacagcgtttttcttttcgctcctctttctgggcatgttcctctctggcatggtggctcaaattgatgctaactggaacttcctggtaaggactttttattttaagtctattgcaggaagatgggagaaacctgtatcctattctgttctgaaatgccagagtcccagttctgttgcccctaatgggagagaagcggtccaaccacagagactgctgtggtgctgcggtggtgtgtggctgccttgatggacaacagggccccagtttgcgaaatctctgtgttgatagagctgagaaataattgttactcctacaacttagataactcttactcaaaaactgtttcatttcatacggcaaatgaattgcattacaattatcaaacaattgaacaaatgcctttgggaactaaacattgtcgcatcttgaaattttccattaatttctgccccagatatttaaatatgtatttttttttcagaaaacaaatacttagaaaagggcatgtttcatattgataataaacgtctgtcccaaattaaaaagaattggtgagtttttaaaaatgaatttgtggccgggcgtggtagctcatgcctgtaatcccagcactttgggaggccgaggcagatgaatcatgaggtcaggagttcaagaccagcctggccaacatggtgacaccccgtctctactaaaaatacaaaaattaccccgggcatgatggggtgtgcctgtagtcccagctggttgggaggcagaggcagaagaattacttgaacccgggaggcagtgagcctagattgtgccactgtactccagcctgggtgacagagcaagactccatctcaaaaaaaaaaaaaaaaagaatttgtgaccaagtgcagtggctcatgcctatagtcccaggactttgggaagctgaggcaggaggatcacttgagaccaggagctcaaggccagcctgggaaacatggtgtaaccctgtctctacaaaaactacaaaaaatatctggacatggtgttgcactcctgtagtcccagctactcaggaagttgaggcaggaggatcacttgagcccaggaagtcgaggctgcagtgagccatgatcacaccagtgcactccagccaaggagacagagcaagaccttgtctctcaaaaaaaaaaaaaaaaaaatttgcaatcaacacaatttttaaaattatgacaccattaaattagatcaactttttgtttagtatatagagcttgtctttcatgcttgcagccatttattctctaagactgttttagaatgactcagaggatcacagtgcttcagggaagttcaggaagaacccccattaggttatgatcatactttggtgtttagaagcttacatcagaccttcagtcaggctttatatatattcctttcaagtataacagcatgttattccacagctttagtgcagatgttaaatatctgttcttgttttatttatagggcataagaggaactgtaatcctaaatgttattagtggtgaagtgtagggaatgtggctggcctttaagccagccctggggcaaatggcatagcttagtataaagctaagaaggaagtggagtaccgtggttacagtcctgcatgggctttgagcatagatctggtttgcttagtagctgtgtagcctcgggcacaattattaacctctctcgattttagtttcttcctctgtaaaatgagaataatatatttggtattgagtacagtcattcatgtccttattaatttatttgttttcccaagtttgcatttcccacccatttgtagcattatatctgatgttcagaaaattaaatgttaagcgtttctgttgttttaattgtgctactctatgaaagtgacagctgaaattggaaatctttgtttcataggtcagctgcaaaggttacctgtggtcttttagctggagtagtcttttagctcagtagctgttactgaggcaaaagatggtaatagcaatgcacagcgttgattgtatggtaggcatgctttctaagagccaaatcttgtcttcaaggaatttatgaaatgttttccctatttcgaaagggcttctctttttttcttcttttgtgtgtgggtcttttttttattattattattcagtcattttttattgcatggcttgcttttgataggtttggtaacatattttgtacactctcccaggaaaactttttagccatgtatataatggaattgtcacaagttggtaacaatttttaattgttgcattctggaactgtcagacattaatggctcaaaaatagttgttttctcctgtgataatagtttaccactttagaccatacttgaaggaagcaagaatgcattttgataaagaacttattttctagatgtatttgttgtaggatattgagtttactatttcttctgggttttattgactaagaaaattacattcatgatagatagcttcagcagtttttcctgagctttctagcttttatataaatagtgaaataaaaatatactatctaataacagatataaagtactaaatacttgcctcattctattctgggaaaataaggagattttggttttgaaacagcttttctgtattttttttctggagaggaaaaaataccatttttgtggaactttaaacagaagattctaaatttatatagtcccctttgtaggggaagggtactaaggaaagatacattttagaaaaatagagctatttaaaaatcctatgcaattaaacatgtttccctttattcccccaaagtataactggcacacatttgatcatttgcctattatggacatcacttaatatattggtttttttaagattttttttatttcaatagcttttagggtacatgtggttttttattacatgaatgaattgcatagtggtgaaatctgagatgttagtgtaacagccccccgagtagtatacattgtacccaacatgtagtttttttatccctccttctcctctccccacccactcctgagtctccaatgtccattataccactctgtatgcctttgcatgcccatggcttggttcccacttacaactgagaacatacaatatttggttttcaaataataagtgagttacttcatttagaataacggcctccagctccatccactgcttagtatcttacattttgtcagctatattttctggccccatattcatttgcttatttgaccttaatgacaattctttatgggtgataagtattcttgttctcatttttacaaatgagaaaactgaggttcaaagtggttgtcatccatttttcttgctgctgttaatgtaaacgaggatccccctatagacgatgcagcttttttttttaagattaactttgtagagttttactacataaacttgcagatagtattttctcactccaactttttttatactttaggttttagggtacatgtgcacaacgtgcaggttagttacatatgtatacatgtgccaggttggtgtgctgcacccattaactcatcatttaacatcaggtatatctcctaatgctatccctccccactccccccaccccacaacaggccccggtgtgtgatgttccccttcctgtgtccatgtgttctcattgttcaattcccatctatgagtgagaacatgcagtgtttgtttggttttttgtccttgtgatagtttgctgagaatgatggtttccagcttcatccatgtccatgcaaaggacatgaactcattttttatggctgcatagtattccatggtgtatatgtgccacattttcttaatccagcctcattgttggacatttcggttggttccaagtctttgctattgtgaatagtgccgcaataaacatacgtgtgcatgtgtctttatagcagcatgttttataatcctttgggtatatacccagtaatgggatggctgggtcaaatggtattcctagttctagatccctgaggaatcgccacactgacttccacaatggttgaactagtttacattcccaccaacagtgtaaaagtgttcctatttctccacatcctctccagcacctgttgtttcctgactttttaatgattgccattctaactggtgtgagatggtatctcattgtggttttgatttgcatttctctgatggtcagtgatggtgagcattttttcatgtgtctgttggctgcataaatgtcttcttttgagaagtgtctgttcatatccttcacccactttttgatggggttgtttttttcttgtgaatttgtttgagttcattgtagattctggatgttagccctttgtcagatgagtagattgcaaaaattttctcccattctgtaaaaaattttctcccattctgtaggttgcctgttcactctgatggtagtttcttttgctgtgcagaagctttttagtttaattagatcccatttgtcaattttggcttgtgttgccattgcttttggtgttttagacatgaagtccttgcccatgcctatgtcctgaatggtattgcctaggttttcttctagggtttttatggttttaggtctaacatttaagtcttcaatccatcttgaattaatttttgtataaggtgtaaggaagggatccagtttcagctttctacttatggctagccagttttcccagaaccatttattcaatagggaatcctttccccccctttttttttttaactagtagatggaagtttgaccctgaaacgaagagcaaacatgggcttaagacaagaatgtgagatatagtcacttgcgggcggggggtggggtggaagctatgcctgaggctgaggttgcccagggaaaaggcaaacacatagtgggcagtgctctggggtgtgtgagcattgataagatgggtgaaacagcaagagcacatgaaggcaattaagaaagtgaaggcaattaagaaagaggctgggttcatctgctaataagtggaggccaggggcctagggcagagatttacaaatggtggtcctggccagaagagcagcagcatctggaaacgtgtcagaaatggacattatcaggttccaccctgacctgctaagtcagaaactctgggagtaggactcagctgtcttgtgtttaaacaagctctccaggtggttctgatgcaggctaacatttgagaaccactgacttagcagaaatgatctgggctgtcaaatgcaatgagtgaggcttgtggaagaccttcttaacacacatcccacacctggcacaaattggaatagtacactcaggatggccaaatacaaatataggtacagtccaccaggggttgggaatagttactgagtagttggccctatactaggccctgggaatacaattgtgaaaaaagacagatctagcagttgctgtcaaagagtttgttgtagtagacaatgtaagtaaattgttacaaaattaatgcattaattaatgttatgttagtagccaaaaaggaaaagcctagcatgccaaaacaacatatgtgtcatctcagcttcactgggaagtagattctaagatggattgagaagtacaagagttttggtttgggctttttgtgcattttgttgttgttgttattgtttaagggaaaggggagataacacttgtaaaagaaaataaaagaggaagtaagatcaggaagaaaacccagaatgatacgctctacaaagtcttgaccaaatccatacaaaacttcagaacacagcctgtcctttgagagttttgtgttgggcacaagtggccaagcactagtacctccactgtgctgtcattagtggggttgggggatatccaggaagaatgtggccttggctcatgcattgtagcagatcgcaaatccactgaagctggaggctgtcagctacctgcacccctcacagctaaacatcaagttccttcttgatggaaaatgtgtgcagtgcacaattagatgctccactctcctctcatactgcagatccatttctccatatacatctgggagtcactcctctggggttcccatgtgcctttcttcctgaagaaagacttaaaggagagaggttagagggatacatgacatctccgttcactggagttggtctcaaggccaactggtactcatcttcttccactgaccattttacattcctcttctcagctttcctgtctggtggtctcagtggtttcctgttggtgaatccaaatctcattcctgagagagtcagggcccctggcaaccacatctgcttcaggccagtattgctacacttgtttgtttttagtcacaattggcagagagacttccaagaagacctcaagtagatcacctgaggtctacatataattcctttcgccctcttatggcacatacacgagggcaatacatgctccttactgccatcctgacttccagcagctctgccttctcttgaagtttagtggcaactacctttgtcaagatggtaactcctcttcctgcctttttgtccctggacaaaagagtccaaagtggccagagagtagccatagcttgtagctcaatgggaccattgctgtatcctctgtccttgtccctttggggacaaggacccctgaccatgaaaaacctagagctgtgggaacataaatcataaaggatttcatcaggttattagaagcgatgacaagtggagaaactcttgcttttacccctaagtttccattcttccaatggggacacaataacatgtaggaagctcttcttcagtgtatctactgcatcctaaaggatgacccccatcctcacagactagtgcctccaagctgtgccttcagccagccattcctttgtgctatcaggccaggccagcagcttctaggtggtgcagtacatgatgcagcccatgggtaggcacccatttccactcctgctttgttgagaagtggtttccttgatcagagactgagtgaatgcagtctgtaaatccttgggtatagctggtggctcaagctcagagagtcataaaagcaaattcataaatcctcgatgccctaggtaattaattgtattttagtgagaataaccattatgggtgtgtgtttttgtgagagtgaaatattttgccctccaggaaggtagaagctcagttttcattcatttactacaggtaagtggttggtccccttgaggataatcccttatcaggagctcagagttggtctctgttgctggcagttcaacattcagaggaagcagtgggtagatcagctttggcaataaggaggccatactcttgggcctttccatggccactttctctgaccatgggtactctgtttatgtgcccataatgccaggtatgggatggttgatgccaaaggattgctaacatcaactcgaagggtccttttggctacgtagcattctaaagtgatgcttctggtaagcattaccaagtgacagaaagatctccacatagtatgcctaatcccgtatcccttccttgtccctgaagctttgaaatgttttatcccatggccctgacaagtacagtagtctatttgctattgatcatcagtctatgtatattctcactgtgggcctctttttttttttttttttgagacagagtcttgctctattgcccaggctggagtgcagtggcaggatctctgctcattgcaacctctgcctcctggattcaagcgattcttctgccttagccttccgagtaactgggattacaggcatgcaccaccatgcccagctaatttttgtatttttagtagagatgggcttttgccatgttggctaggctggtctcaaactcctgacctcaagtgatccaccacatcggcctcccaaagtgctgggattacagacacgagccactgcacccagctatgggccacttttctttctgagcaaagtgtgtaacatgcatcatcactcagctctacccattgggaaaatagtccctaaccactgtctttcaaagccaactctgaatgtggctataatgcacatacaatacagctgctgtccctttcaaccttgcaaccacataggagccaactcttccaaaaacaaagctcagggtttttttctccttcacgtgggcataaggaaaccactcttccctgtggccataggtacgaactgaggaaggacagcagttccactctggtgggtaacatgagagcctaggctacctgctcttgcagttacctcttgttaactggtcttgctcaggtcaatatcatatgtgcccttcccatcacaaggagacagctgctgacccacctgattttttgagttagtggcttccatggaacccaacccaaaataagcagttctggatgcctggccactggtgtcaagtgtttcttctctaccaggtctagtaccaggagctacttttcaaacacttgtcactctccagtgcaggttactagaggctctaaaactccaggaacctccagtgattttcacattggcattgccataaattccacactatgtactttctcctaacaccaagagtatatatgaccctggctggataggatgacccaagcatatggagtgagaagcgcgagaagtgtgttgggaattaacacctataaaagatgaaaggggaagaaataggattggacaggaaagccttgaaaccacaatttaattcagatacttctgaaaaggagggaggaagaagcaaaattggcaggattgggggggcgggaaggggcaagcagtaattgcttgtgggcagaatcctttctggcagagacaataccatgtgtaaagagtagcatccttgagctataaaatgcttcctagggaccaaaatgaggtgaatgtgggtgacattgaaaaaggtatgtaatggtagagaaattaagggatcagatcacacgaagagttgcaggtcctgtcaccaaatctctttatttaaagataaactatttctgatgattcacctcagtaagttaaatgagtgcctaatgatctcagacaaattttctcttaatttttcttactaagatctagcatcatttcatttagccattaaaaatggtgacatttgaatttggggtttgaccttcatcagctaatatttgttgaataaccacatgtatttgagcatctctcctacaaacgtgtggccagtatgtaacacttttcttaaatcttttgaaggcatttgtgaatcagtttacaaatgagagttatttaatagaaagcacacctttgtagttcttacccatggttagttaaatttgtcctagcagagtattttagatgtgagaacagtttttttttttattttttgtttgttttgaggcagagtcttgctctgttgtccaggctggagtgcactgatgcagtcttggctcactgcaagctccacctcccaggttcacaccattctcctgcctcagcctcccaagtagctgggaccacaggcgcccgccaccacacccagctaatctttttgtatttttagtagagacagggtttcactgtgttagccaggatggtctctctctcctgacctcatgatccgcccgccttgacctcccaaagtgctgggattacaggcgtgagccactgtgcccagccagatatgagaacaatttctataaacagtatgatttgctgtatgggcatttacaaaagcagtgcaatgctctcctttgtaatattgctataacggtaatagaaatcaataataggtttgataggaaagaacgtagacttcaaagggaacccttgcacactgttggtaggaatgtaaattagtgcagtcgttatagagaacagtgtggaagttcctcaaaaagttaaaaatagaactaccatatgatctagcaatcccacgcctgggtatatatccaaaggaaatgacatcagtgagatatctgcattctcattttcaatacaccattattcaaaacgccaagacatggaatcaacctaaaggccagtagatgaatggataaagaaaatgcagtatatattcacaatactaattgcctttaaaaaggcagaaatcctgtcatttgcaatatagatgaacattgtgttatgtgaaataagccaggcacggaaagaccaataccgcatgatctcacttatatgtgaaatcttgaacagttgaattcacagaagtagagaatagaatggtgattaccagggtatggggtgatgggggactggggaaatgttggtcaaaggatacagaatttcagttaggagaaatgagttcaagagatctattgtacagcatggcaactatagttaataacagtgtattatattcttgaaaaatgctaaaaaatattttagatgttctcaccacaaaaaaaagataattttgggaggttttatatatttttttatatatttatgtatatataaattagctccacttagccatcccacaatgtataaatattccacaatgtataaatatttaaaaacatgtacacgataaatatgtatttttctcaattaaaataattttttttgaaaactaaagaaactggactttgggactagacacactacatgtttttcttcctccaaaagttaatatttgtctggcttcaaacagtcaacagtcatttaactgaaaagaaagaagaaattctttgtaaaatggagataataaatgatggttataaggatgagtaataatgcacataaggtacctgatatgtgggagctattaaaaataaacagtgatgtgttgatggtatattaattcaggtaagacaatatgaactgtaatagtgttatgcttcacatgaatgtcagcaacatacaaagaagcctaataaacgagttcttatacttttggtggaagtatatatgttagtagtttttaatgaaatatatgaatatatgttattgaattctattagtcttctgtatctttcagtggaaaatctctaatgataaaaataactgctcaaaaataaaattacataatgtgtatgaatacatatcataaccataataaaaagatgttatttaaatgctattttacttgaattttaaagacagcatatgttatggcttttttatattatcctaattaacattgatctctatggcatcttaatccaaattaaaattacatattattaggagcaggttgttcagtttccatgtagctgagcagttttgagtgagtttcttaatcctgagttctagtttgattgcactgtgggctgagagacagtttgttataatttctgatcttttacatttgctgaggagagctttacttccaactatgtggtcaattttggaataggtgtggtgctgaaaaaatgtatattctgttgatttggggtggttgggtacataacaaaatgaaggtagaaataaagatgttctttgaaaccaatgagaacaaagacacagcataccagaatctctgggacacattcaaagcagtgtgtagagggaaatttataacactaaatgcccacaagagaaagcaggaaagatccaaaattgacaccctaacatcacaattaaaagaactagaaaagcaagagcaaacaaacacattcaaaagctagcagaaggcaagaaataactaaaatcagagcagaactgaaggaaatagagacacaaaaaaccctctaaaaaattaatgaatccaggagctggttttttgaaaggatcaacaaaattgatagactgctagcaagactaataaagaagaaaagagagaagaatcaaatagacgcaataaaaaatgacgaaggggatagcagcactgatccacagaaatacaaactaccatcagagaatactacaaacacctctatgcaaataaactagaaaatctagaagaaatggataaattcctcgacacatacaccctcccaagactaaaccaggaataagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattcctatcaatagaaaaagagagaatcctccctaactcattttatgaggctagcatcatcctgataccaaagccgggaagagacacaaccaaaaaagagaattttagaccaatatccttgatgaacattgatgcaaaaatcctcaataaaatactggcaaaccaaggggaggagccaagatggccgaataggaacagctccagtctacagctcccagcgtgagtgacgcagaagacggatgatttctgcatttccatctgaggtaccgggttcatctcactagggagtgccagacagtgggcacaggccagtgggtgcgcgcaccgtgcgcgagccgaagcagggcgaggcattgcctcacttgggaagcgcaaggggtcagagagttccctttccgagtcaaagaaaggggtgacggacgcaccgggaaaatcgggtcactcccacccgaatattgcacttttcagaccggcttaaaaaacggcgcaccacgagattgtatcccacacctggctgggagggtcctatgcccacggaatctcgctgattactagcacagcagtctgagatcaaactgcaaggcggcaacaaggctgggggaggggcgcccgccattgcccaggcttgcttaggtaaacaaagcagcccggaagctcgaactgggtggagcccaccacagctcaagaaggcctgcctgcctctgtaggctccacctctgggggcagggcacagacaaacaaaaagacagcagtaacctctgcagacttaaatgtccctgtctgacagctttgaagagagcagtggttctcccagcatgcagctgaacatctgagacctggcagactgcctcctcaagtgggtccctgacccctgaccccggaacagcctaactgggaggcaccccccagcaggggcacactcacaattcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacataaaaactggaaactctaaaacacagagcacctctcctcctccaaaggaacgcagttcctcaccagcaacggaacaaagctggatggagaatgactttgacgagctgagagaagaaggcttcagacgatcaaattactctgagctacaggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagcgaatgcgatcaactggaagaaagggtatcagcaatagaagatgaaatgaagcgagaagggaagtttagagaaaaaagaataaaaagaaatgagcaaagcctccaagaaatatgggactatgtgaaaagaccaaatctacgtctgattggggtacctgaaagtgatggggagaatggaaccaagttggaaaacactacaggatattatccaggagaacttccccaatctagcaaggcaggccaacattcagattcaggaaatacagagaatgccacaaagatactcctcgagaagagcaactccaagacacataattgccagattcaccaaagttgaaatgaaggaaaaaatgttaagggcagccagagagaaaggtcgggttaccctcaaagggaagcccatcagactaacagcgggtctcttggcagaaaccctacaagccagaagagagtgggggccaatattcaacattcttaaagaattttcaacccagaatttcatatccagccaaactaagcttcctaagtgaaggagaaataaaatactttacagacaagcaaatgctgagaggttttgtcaccaccaggcctgccctaaaagagctcctgaaggaagcactaaacatggaaaggaacaaccggtaccagccgctgcaaaatcatgccaaaatgtaaagaccatcaagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagagagatcaatgagatagaaagtcaacaaggatacccaggaattgaactcagctctgcaccaagtggacctaatagacacctacagaactctccaccccaaatcaacagaatatacatttttttcagcaccacaccacacctattccaaaattgaccacatagttggaagtaaagctctcctcagcaaatgtaaaagaacagaaattataacaaactctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacatagcagaatctctgggacccattcaaagcagtgtgtagagggaaatttataacactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcagtgaatccaggagctggatttttgaaaggatcaacaaaattgatagaccgctagcaagactaataaagaaaaaaagaagaatcaaatagacacaataaaaaatgacaaaggggatatcagcaccgatccacagaaatacaaactgccatcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgcaactattccaatcaatagaaaaagagggaatcctccctaactcattttatgaggccagcatcattctgataccaaagccgggcagagagacaaccaaaaaagagaattttagaccaatatccttgatgaacattgatgcaaaaatcgtcaataaaatactggcaaaacgaatccagcagcacatcaaaaagcttatccaccatgatcaagtgggcttcatccctgggatgcaaggctggttaaatacatgcaaatcaataaatgtaatccagcatataaacagagccaaagacaaaaaccacatgattatctcaatagatgcagaaaaagcctttgacaaaattcaacaacccttcatgctaaaaactctcaagaaattaggtactgatgggacgtatttcaaaatagtaagagctatctatgacaaacccacagccaatatcatactgaatgggcaaaaactggaagcattccctttgaaaactggcacaagacagggatgccctctctcaccattcctattcaacatagtgttggaagttctggccagggccatcaggcagaaggaaataaaaggtattcagttaggaaaagaggaagtcatattgtccctgtttgcagatgacatgattgtatatctagaaaaccccattgtctcagcccagaatctccttaagctgataagcaacttcagcaaagtctcaggatacaaaaccaatgtacaaaaatcacaagcattcttatataccaataacatacaaacagggagccaaatcatgagtgacctcccattcacaattgcttcaaagagaataaaatacctaggaatccaacttacaagggacatgaaggacctcttcaagaactacaaaccactgctcactgaaatgaaacaaagaaatggaagaacattccatgctcatgggtaggaagaaccaatatcatgaaaatggccatactgcccaaggtaatttatagattcaatgccatccccatcaagctaccaatgactttcttcacagaattggaaaaaactactttaaagttcataggaaccgaaaaagagcccgcatcgccaagtcaatcctaagccaaaagaacaaagctggaggcatcacactacctgacttcaaactatactacaaggctacagtaaccaaaacagcatggtactgggaccaaaacagagatatagatcaatggaacagaacagagccctcagaaataacgccacatatctacaactatctgatctttgacaaacctgagaaaaacaagcaatggggaaaggaatccctatttaataaatggtgctgggaaaactggctagccatatgtagaaagctgaaactggatcccttccttacaccttatacaaaaattaattcaagatggattaaagacttaaaccttagacctaaaaccataaaaaccctagaagaaaacctaggcattaccattcaggacataggcatgggcaaggacttcatgtctaaaacaccaaaagcaatggcaacacaagccaaaattgacaaatgggagctaattaaactaaagagcttctgcacagcaaaagaaactatcatcagagtgaacaggcaacctacaaaatgggagaaaattttcacaacctactcatctgacaaaggtctaatatccagaatctacaatgaactcaaacaaatttacaagaaaaaaaaacaaccccatcaaaaagtgggtgaaggatatgaacagacacttctcaaaagaagacatttatgcagccaaaaaacacatgaaaaaatgctcaccatcactgaccatcagagaaatgcaaatcaaaaccacaatgagatatcatctcataccagttagaatggcaatcattaaaaagtcaggaaacaacaggtgctggagaggatgtggagaaataggaacacctttacactgttggtgggactgtaaactagttcaaccattgtggaagtcagtgtggcgattcctcagggatctagaactagaaataccatttgacccagccatcccattactgggtcccaaaggactacagatcatgctgctataaagacacatgcacatgtatgtttattgcggcattattcacagtagcaaagacttggaaccaacccaaatgtccaacaatgatagactggattaagaaaatgtggcacatatacaccatggaatactatgcagccataaaaaatgatgagttcatggcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggagggatagcattaggagatatacctaatgctaaatgatgagttaatgagtgcagcacactagcatggcacatgtatacatatgtaactaacctgcacattgtgcacatgtaccctaaaacttaaagtataataataaaaaaataaaattacatattataaaattcagtatatggaaaggtttaccaatgtgccaattaagatgggtcagttgattttcgcttgggttctgatagtctaacatttctaaagcagctaagcttaacagtgaatatagttaagattgtttaattaaatgttttgatcttgctaaacctaaacttcattatttaaaataaggaacagaaaaatatttttttttaattgcagatgtcttttctctcctcttttaggattttgcctaccattttacagtatttgtcttctattttggagcctttttattggaagcagcagccacatccctgcatgatttgcattgcaatacaaccataaccgggcagccactcctgagtgataaccagtataacataaacgtagcagcctcagtaagtattcatattcaatgagtaccattcaccagcacttccgctccactgtcaaggcctccaagaaactcctcaggcaacaatagttttcttcaatgctagccattggcattaaatatgtaatagctatttatctgtacaataaccttgtaagcaaagtgccatgatcacccccagtgttgtggatgattaaactgtagcacgaagaggttgatgttcatgtaagatcatagcaagccagtaggactgcttggctttgcacagcagtgtctactttgcaaaaagagttgtgttttttgcttctgataactttcagagatggtaaaggagatttccagttttgttctttagtattcaatagctgcttgcaatttatttctattgaatgaatagttactgtgggcctaccatttatcaagtaattttgctgggtgttgaggatggggtgaataagttgcagttcctgccattaaggaaagtgcaggtgagaaagggaggcaaatatgccagccattgcagtagatgataggcagatgaaatatattccttggggtatttattaaattttttaaatcatctttaattcgtatactggagtgaatttgtcattttgtgtagataatttgaggaaataatatattatttttgttgttagagatcattgttaagatgtcagaagtccaaattagtttctgaaatattgtgatatttaatataagtatatggcaagttagtgaccctaatgttttattatgttccccaggtagcctataaataacccagtactcatatagtcattgaaatctgtctggagcagcactgtctagtagaactttctataatgacaggaatatttcatgtaagtgctgtccaaaatggtggccactggcttcatgtggctattgagcagttgaaaattaactaggccaaggaatcatagctcatgcctgtaatcccagcacattggtaggccgaggtgggaggactgcttgaggccaagagtttgagaccagcctggtcaacatagcaaaaccttgtctctgaaaaaggaaaaaaaacagaataaagaattggccaggcctggtggcttgtgcctgtagtgctacctactcaggaggcggaggttgcagtgagcagagcagtctgagcgacagaccaagactctggtcgggggagagaaagataactagtatgactaaggaacttgaatttttagtgttatttaattttaataatcacatgtgcctagtggctatcatgttagataatacatgtctagagtgagttttgaggggtacaagacaaatgatttcaagacctattgtaagtttcccaagtctctggtaggatttgtcaaaatttattgagtgcctgcaatgaattaggctgaaggtgggattacaacaaaaaggagtcatggttttagctttgaaaggtttatagtgtagattcatgactttaacacttgcttataaaagaaataaaggttttatttaatcaattcttacctaaaaccccaataaatctagaagataaaagtgtaagtgctctagttgaagtggaggaagagggccttgaatgatgctcattctcttttcataaagctgcctctacccacccatatcatccctgaggatgatagaatccttgtgatccacattagaaaacccttggttttaacagctttacaaagcaaagttcagggactttcctatgctattagtcatcaattcccattgtatttgcctttatgtgtttcttacttccagtcccttcattttaacggtgcaggctagattcttgtatcttggatcattgaagtagccccaaatctattgacagtcaccctagaacctactttcacaagaatagtagctgctgaaatacgtgatggttgtctgaggtctttaatttgtcacctttgtcctaagggcctagttttccgtgttctccataatgtagttctgttctggctgcttctcttttgtgactttgtccctgttgtccttccctttctaagtgaagctgtctcagtaaacctctacatgcttcaagttcaacattacatcccatttcatccatatgctcactccagtctaagtaaatctctagtttgagttttattgtaactaaaatgtattagccatccatttgggaaattagagaggaaaattccttttccctaataataggtatcaaataataggtatcaaaaaataggtatcaaaagctattgctgtcattcagaaaacaatgtctagattagaaatgtatcagagaaaaaatcagcagaagaagggtggaaagaaaagcagaatagtaaactgtgaaaatggtctataggtgaatctggtattccttcccagaactggtttcctggttaagaatccctgtgctaaacccacaacatttatcaaacatttatcatgttgaactgcttttgctttgtcttttagtcttctatggatcataagccccaaaagggtgaggacattatctactgtttgtttatatgtaccaagtatagtgatatacacacagttggtgctgaagaaattctcattaattccaagtagagtgcagatttgtacacaggactgtctcccatacaagagcaagccaacctgataattcatttccacttgtcttagttgagttttaaagttaccttccatcatcatagaaattatttgatgcatcctcaggttctgatagttgctggcttccttggctgtgaagccactacatgaacagaacttcatgctgaatttttaaatacagtgcttagggattcacaaatacttaagtgagcccagaatgtgaacagattgaacaaatgttcagtgtaaagttgtccacaaatgagaaaattattaggagctaaaatgtttaaaggaaggggggagggtaattgtatgagggaataaaacagttgtacaaatcatcaaaaaaaaaaaaacaatgtaaaatatttttgtaagtgtcgaagtatctttaggtagattgttggtcaaacttcatatggttgttctttaggacactgtttataagtcggtgttgtaaatctgatgtgaatttttgtttcttttttcttagatttttgcctttatgacgacagcttgttatggttgcagtttgggtctggctttacgaagatggcgaccgtaacactccttagaaactggcagtcgtatgttagtttcacttgtctactttatatgtctgatcaatttggataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaattagtatcccttttgtttggttgctgagtcacctgaaccttaattttaattggtaattacagcccctaaaaaaaacacatttcaaataggcttcccactaaactctatattttagtgtaaaccaggaattggcacactttttttagaatgggccagatggtaaatatttatgcttcacggtccatacagtctctgtcacaactattcagttctgctagtatagcgtgaaagcagctatacacaatacagaaatgaatgagtgtggttatgttctaataaaacttatttataaaaacaaggggaggctgggtttagcctgtgggccatagtttgtcaaccactggtgtaaaaccttagttatatatgatctgcattttcttgaactgatcattgaaaacttataaacctaacagaaaagccacataatatttagtgtcattatgcaataatcacattgcctttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttggaatcgtttactctgctagaatttaggtgtgagattttttgtttcccaggtatagcaggcttatgtttggtggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttg

SEQ ID NO: 2 - DNA, 6924 bp, Homo sapiens
ctcttgtctttatagaactgcctagaaatcttgtgtaggcacggagggcttgagccagaaaggagagacaagtgcaatcggactgtgcatgatgttgccactgatgactgcaagcatttgctggagaatctgagtgagtgatgttcagagcttattgtttatctttcccctatgctgctggggcctctggtacaatgggaaaaactatttacatcttttgcatgtcctttttaacctttttggagccctagctatggcaaaaatactgactgtaagtgtgataattaactatttttccgtgtagaatgactttttgtagaactaattgctattcaagtaatgctggtttctccttgtattttactgacctaggacagcaatctaaatatttattgcatttttcttctgacttagattgtctttctagatgttagactggcaggatatgaaaaatcccagctatgtactctgcatcagctgattgtatgaggcaggcaagttggttgtctcccagcacctggtcgcctacttttctatgaagataattgatcatcttttgggtcccttccagctccacgagtatatgctcctcagcattttataaaggctcacttgtgggtttatgagtgtggagtatagaccttacaaaacatcatgacctcttatattaagattatcacccaatccatccagtcagccagctgtatcagtaattcaattttaggataagcaacattttaaaaattgaaataatgtttttatcttcaacctaatacatacattcatatacttttattttgtgaagaaaatttcagaatggtaaggaagcatatatgcaaactgtgtaagtatactttaatataaaatataaaagagaataatagaaattctctttaaacccgagggggtttttttggttgacagaaggctttatttatcattgaagtctaggtttcgggtccttaaacttttgaatcgctgctcagtgtctgaaacagtgtcttatacagaatttctctaaaatagttctcttattacaagctgatgctaacctaagaacaaacatggaacactttctgttgagctaaaattttattatggaatgtaaatgctgtcatttaattatatttcactttctgatattaaacatttaaaagtagaaggaataaatatatatagctatggtatcttagatgtgaaaaatatgaagcatattggcatggctgggatagaggtgtgattagaggtggggaattggaaggatgagacagcgcaattgatgttttgggcagtttaatgctcatttcagtagttttgaccttacattggcagtcaaagataagccaatgagattgttgatagtgcataatgtggtacaaatggtgttttggaattctgtaggcagctctttctgggacaaatcaacctatagagagtctggaaacagatcaagcatcaaaaagttttaatgatgtgtcctcagttggaccagggtggaggagagggaaatggtatataatgagagggatgggaaatcctaaaattgaggattaaggaggactttatgaaataaagactgatatgggagacctgagtataatttctatctcagacatgttggcaggatttgcagatgtacatcctgtggaagactggacattaggtagtgtgatttaagggaaagggcatctgaatcccagtatccagatgtctgtgtaatgttagacaaggtgcttagccttctctcacctcagtctgctcacctgttaatagggttagtaattattcgtatacctgagtgcaaaagagtggatcatttcttaaggtctttctaagattccaattctgacaatctgagagaagtaaaaaagacaggatatgcatttagattatgattacttccataaggcttatgataaaagctgcgaatgcaaatgaactatagaaagtaagtggggccaggtgtggtggctcacgtctgtaatcccagcactttgggaggctgaggtgggcagatcacctgaggtcgggagttcgagaccagcctgaccaacatagagaaaccccgtctctactaaagaatacaaaattatctgggcgtggtggcatatgcctgtaattccagctgctcaggaggctgaggcaggagaatcgtttgaacccgggaggcagaggttgcagtgagccaagatggcgccactgcactccagcctgggtgacagagtgagactctatctcaaaaaaacaaaacaaaacaaaaaaaacctgaagaacagaatatgtcaaagaagaacaaagatgcacaattattttcatttattcaacaaactactcctcgcctaagcacatagctagaagtactcttgcatgtgtgtatcaggagacatatgaaaatgtgtgttgcagcattgtgtgtaatactagaaaactgaaagcactctaaatggaaatctattaggaaatggataaatagaataaactgtagaaaattcatattttaaaggtaccaagtagcacttaaaaataaattttatctatataaatcacctgaaatacattaaaaaagtgttgagtgaagaagtcagttatagaaggacacataatataaaaccatctgtgtaaaagtttaaaaatacaactccaagcctatatttgttataagtaccactaaataaggcaaagtgtaaaaatatgcataggggaggtaagagcttccctatggaagatttaagtgaaaattgaaaggctgagccaagaaagagtggaaaatagagccattccaggtgaactagcagcatatctggaggcactgaaggggatgtgctttggagtctttagaggtatttagctgtatctgcagtgctggggagaggagggagatgagtatgggaagtctagagtcaggtcataaaaggccttgtattccttttgactcaatcttccatgtaagttttgatgcaatcctgtggacatgaatgaacaattgaacgattgtaagtgaggaagtaagatgtaggtaatggggaaataattgtcttgatcttgatacacaggataccatagatggggagcatgactggtacctagtaagagggaaggagggctgaacaagccagggagtcacagggctggagaacagggtcatggttcaagtcataggggtgctatgagacaggaatgatatacagggtgaggggaaaagcaaactgaaggccaagcccagagaaacccccatttttagggcagaaaatattttttaaaaatgaccctaaaagaagattgggaaataggaaggaaaagagccaaaaaataatgttgtatggtcaggcatagtggctcatgcctgtaatcccagcatttgaggaggctgaggcaggaggattgcttgagcccaggagttcaagaccagtctgggcaacatggcaaaactccatctcttcaaaaaataaaaataaattgccaggcatggtgacacgtgcctgtagtcccaactgttgtctgctccatgggtgctgaggtgagaggattacctgagccagggaggtcaaggctgcagtgagtcaaggtggcaccactgccctccagcctgggtgacagagaaagaccctgtctcaaaaaaaaaaaaaaaaaaaaaaagaagaagaagaaaaagaaaacaatggtgtaattggattcaagttaggagacctttccaacaggaagaattaatttaatagtatcacattccctagactataaggattaaaaagagtcgattgcatttggcaaatagaagttaccgctaacagggagacaagttttgtgcagttacatagaagctgattattttaagctgagaataatatggaaagacagtggaaaaaatctctggtagaatagttttcttcatccattgaataaacacctttttattaattcattgaacatatgcttattgagctgctcttgtgccagtcactatcttagccacttgatgtaagtcagaaaatttttaagaagattgttctcatcctgaagcttatagtctaacattaagagataaaatgaacaataaatataagaaaaatttattttttggcattgtgaggtggtgagatatgctatggaaaagactaagggggatgaggatttaaagggtgtgtttcagcttttaaaatggtggccaagtttgcctcactgatgagacattgaagccaaggcttgaaggaggtgaacagggcagctatgtggatatctaaggttcaagaagctttagcacgagttggacagaggcctgaggtagcagcattcctgttgtgtctgaggaactgcaaggagggcaggatgactgggttaaaaggaaagagaagcaggaagacgggtcagagcagtagccatttcagtgtttgagtgcaggagagcagttacagggtggagcgtggcctgatcttgttggaatgcgtaggccattgtaagaacttaaggtagccattgcagtgttcgattgtaggagagatgggatctgatgcacattttaacagtagcactggctgctttgttgagaatcagctataggaagtcacagataaatcaggaacagctgttagtacatgcatatggtattccaggtgagagacaattatggtggctcagtgtaggaatgcagcagatgaggtaatgagaaggacttgggttctggatacagttgaaggtagagtcaacagaacttcctcatggattgaatgtgaagtgtgagggagtataattcaaggtgttcagtctgataattcaaggtgttcagtctgaccaactggcacgatggagttgccagtacttgttagggggaaaggccatgagtgaaacagattttctcatgtagttggggagttcagatttggatgcaggaatttgagatgtctcttaggatatctgtgtggagatgtcaagtcagcaggaattcctgagacgagtgagagctgggtgaataaatgtgaaggtcagcagtctatcagtgatatttaaagtcatgggactggatgagatcactaagggaatgaacatgcacaaaataaatagagaaaggagccccaaaacacactatcattaagaagtctggaaaaggtggagagaacaacaaaggaacaacattaaagagcgaccgaggaggtacaggagatccaggaggagtatatcaaggagcaaagagagatcacttttgtcagatactgtggataagtaagatgactgagagtcagaaaatggaaaataagtaatccagcagttggttacttaatggaaaaatctaagtttaagaagaggatcatataaacaaacacatgttgttttaaaacattttaattttaaagcatacaaaggaattttttaccaaagtttagatagaggtctttagtacaggttctactgattaaaatttcacatactcttgtttgaaaaaaacatacctttgatgcatcatctatgatttctaatgtttgactgcttaaacacatttatgaagcaaactaaaggtaatacctgtccagagattattaaaccatttctaatttcatatagttgtcccatttatacctcattagataaaattttttaacagttcctaaactgtctctaaaggattcaacttagttttcataggaacagtaactcatatttcatcaatttatggaatacttaattcaataattatagtcatcagttcaatgaacatagaatatttggaaacaaacacaagtaactcagcatacaattcagtcatgagaacagaagtagatgggggtgctacccactctgctggagcctcagtcggagaaattggaaagaacatttcaaaagttaaatcctgctaccctgttaaccatttatcaaatacttactggtatttaccacataagaatatgtaaaatctattacaaaagtaagttcatttatttttcacaccaactcgatatacattccctccattttatggaagaaattggggtacagagagatcaatttacaagaacacgcatctataggaggctgaccctgactctgcggttcaacccaaggtctatatgattctcagttactatcctaagcatcccgacctgtccaactataacctgcctcatccatgacattatctatgaaggaaaggagaatatagagaattcagggtcaagggagggttatagttctttcagatttttttttttaaaacttgacaatcttgctgatgggaaagagttaatgaaatagaaaaagccaaagatacaaggaaagagacagttcgtgcagcgtgcttccaaagaaactgaagagattgggagacaaaagtttactccagtgtaagaacgttcaatgtaatgttatttaatgaaataaaatagctttggtttataatttttaaatgtttatatctgcttattttatgtaatagttttactttttttttctgtccagatttttttaactcctaattcttttactcttctaacagatgctcttaaaatacccttaaggatttcagtgggtgagattgaaccaagcaactatggttctgatgacttggaatgtgaaaacacaatatgtgctttaaatatccgcaaacagacatcatgggatgatttttcaaaagcagtgagtcaagctctgacaaatcatttccaggcaatctcttctgatggatggtggagtctggaagacgtgacttgcaataacaccactgattccaacatcggcctcagtgcaagaagcatacgatccatcacgctaggtatcagcagtcctatgacggagagaaagtgaaatttctgggtttatttatgtttgtgggtttcataacctgattcttagttcattgattaagcacattcaaagcttacttgtggcagctgccggtgctgaaaaacttgagtattcacaatgtagccattatgtaat

SEQ ID NO: 3 - DNA, 234070 bp, Homo sapiens
actcaccactcgcctcctgagtgtctgacatctgtttctggcaaggccaataatgagtatgctgctagcttcatatcaaatgagagtctgatctacacctattttgtttttgttttgttttgtttttatcacagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggtaagtggctttgaactggcagtgttcttcaggctggggtgttgaacatatccatttgtaagggagaaactttctgccttgttctatccccagggcatccacaagcctcaatttccagcttctttgctgcagaacattctgtttcaaagaaagtagtggtgatgcctctttaagacatgaggggtgaattattattatgccttgttgtcatgtggtgctccttaagagtcttcagaataaaaaaaaaatccaaacctctatcttgttggtggtggaaggaacactttaagtctggctttgccttttatgatctctgtaaccttgagaaagtctgtgactccttctctgacatttttgtaatctataaaataagctaagtggttctgggtttttaggtcacagaaagcagcctctcctgggcatttcaaagaagaagataaacaaccaaatataggaaaagtgtaggtttagacccttcataaagctccagatagaacttcagagatggtctatttatactgtgcaaactgttttcaactctaagagctatgtttatatatgcaaataaaacaaatgaaatgaaatatttatttgaaacagggtctttccaaagtagaaggttctcccaaagttttgagaccatttggttagctttttgcctctccttacctccagaagaagatcagaggtagcttagccaaactggtgggataaatttaggagaccagtgagcaaaaaacagaggaaaatctatgtggatagcaggtccaaggcaatataaaagatggagcagccaatttaaaaaaattgttacaccaaaaaagactgatgtagtaaatattttatggacatcgtaatatgtacataggaagaatgtttctacagtaagttttggcacctttttcctattcctttgtacctctgccactcaaattgatttgatctgtaatcaggcatttcccaagaggtgttttctagctccttctgagacatttacaacagctactaccatttggtgctggtgccaggattgatcaataggactgacaataaccctcccttcataaatatggaaagctaaaaacaaaaaacaaacaaatcgcagagtagaggattttaacttttttaaaaaagaaaacagccctttatttaaaaatctgtataaactgaatgacctttacacatcctaaaggtcttattaaagtagaaatttaaagtaatatttaaagaggcaggtatatacacagacaggtaccttcttatgtagcttacaataggctgttactattttacttgttctaactctagagtctttcaaatctaattataaatcacgtaagaatttgtacaagtagaccttaggctgggcatattccctgctccatcattccccaaagccatttttattgggagtgttccttttcagaaacttgacctcaattaatggagatacctatcacacactcctctgtatggagacagaaaaagctttgtccattgcttcaagtatgggtcctgattcattctcttccttttgaattgcaggcaatccaattgttatatgatacatttcgtattaagttttaaggaaggttccttaattctcaggggctttggtgaatggaaaattaaattaatttggaaacgatacatcccttaactccatgacaatgttctttttactaatatgaaagaacaatcattcctctggttgatagctccactttttcctctcttctttctgtcatagagataattaaaaatagtggttagaatcatttagataaagcatcagcatggtgtgttaagccagtcttataatttctggcaaattttcagtgtaggtttttgacagaaattctttgttgaggtgcaaaattatctatcttcaatgtaaatcagatatatttcaaataatataaattatttttcacacttaaaaattattttctttaaaacaatgctggtaccaggccagtgctaattcactcaccttttttttttggcattgaaataagttatttatgtctacatctcacttctggatgaatatagctcttctctgagccaaccaaagctcagatccctgagctgcttctactctaatacctcctcatgctgctcagtttccataagttcatgaaaaagtctctgaaatattattatcttcagatttgcctctaatcttctacaatctactagtttcttattaaaaaaaaaaccctttaagtctatagacagtcaggcctgggacctcattctagggcctccattctcctgctctgtggatgcccacactcccatcagggttcagccacttgggaatccttcactttcccccatcgtcagtcacaatagtagattaatagccattactatcattgcaattaaaacataatccaatttcttcctctttaggtacattaggagctcttaaggcacatctgattttaggagtgtgaaaatcagttttataatagtgtatacaatactgtatactattatatgtactattgtggtctgttagattgtgaaacatttaaaagaagtacaatacaaagattttgtgcttatggaacttgtagtatagttagaaaaggaaattaacactcgttggataattatgtacttctataagcaaatatcaaattgtataaatattatgcatagctagcatttattgaatacataccatatgttaggcattatctttgccttatttctaattctcacaacccaacttttaatttattactatcctattttacctgagaaatctgcatgtaggacagttaaataagtgaaataacttgttcagggttgcacatgctgaatggctaagaggggattccaagctaggtctatcacattctaacactgcgctaattaagagtcttcttgactaatgtggtggttattttttttgaaaatggcaatcttgagtgatgcatctgggatggtgaaatgtttttgaaagagttcacattgaaggcatgcaggagaagaaataatgaggagcaacagtggtatgcttaagtataggcattcctatgataattccaggaatccttgcattatgctataatataagtgtgctggaaattatttagttgtaggtagttatgattgtttaacaactctcacaaatcacttatttggaaatatatttagcacagatggcttgtcatctcattgtgctttaataaccaagcagtgaactgctcttcccaacttatagtatttttatgcatttatattatgtgtaaataattcattaagatccacatcatcttagcctattatatatttcaaagaaaagaggcaaaatggtttcatagtatgaaagccatcgtgggttgaaacactataccattttctctaccaagacaggtttcagacattgatttaatttggatcactctattcattttaaactgcccccaaatagaactgtttctaagttaggaaaccaagatatagagaggctaagcgatttgaccttaccttacagttagtaccagagcagagcctaaaatccaggtctcctgctaggtgggctagtctggtttctactacattatacttcttctcaaggtaagtgttgtatgacaaaaattgtaataaatctcaacctggttgtcagtggaatcctccagctatagaaaaaaatcaaacttgaggccaggtttcaagtatgatttttgtttttatttttatttttttgagaaggagtctcaccctcttgcccagcctggagtgcagtggtgcaatcttggcccactgcaacctctgcctcccaggttcaagcaattctccagcctcagcctccagagtagctgggattacaggtgtgtgccagcacacctggttaatttttatatttttaggggagatggggtttcaccatgttggccaagctggtctcaaactcctgacctcaagtgatccactcgcctcagcctcccaaagtgctgggattacaggcatgagccaccacgcctggcctcaagtggcatttttactgggtcaggaaggaagagcctgagtgggaaagcgctcctcattttctacttgatggtttgctttcttgtcacgtgctgcatagggattttctgattcttcaaactggattagtagatttgcaacagtctacattcaaataaagcattttaacaagtaatagacacatttatacttcctgaatgcgttacacctcctctctgtggaagcaggaaagaatgggagggtcagagtacgcagggttcagattagctagtttgaacaacttcaacttactctgggacacaggaacgatccctcagttgcctggcacttaataagtcctggagcgattagggcaggtggatagtggcccagagtgtgaaagccctataatggaggtggttgggagtgtgtgctctggattggttggtttgcctttgaaaagagtgctccagtaagttgtttactatctctagaaactggctaatcctgggagggtcagtccctgcagaatcagtgaggccccaaatgtcaaagcatcagaatacaaaaaataaaaaatctaaaaataaaagacatggttaatatggagggaaagttcttggggcctcaggggcagtctctgtcactaatttcactctgacaaatgctgtgattcccaactgtctcactacaggattggtatatttttgggtctcagtatttggagacctagtacattgagtcaggaaaagatctgacagattttctggctcaacctcctcatttgatgatactactaataatagcaacatttatcaagcccagtgctgacccataaaataagcactttatgtttccatgcattttaaaatttattttttgcaacaaccaaataaaccaaggtggtattattagctctcttttatagcaaggaaacagaaaaccagaaagacaaagtgatttgcccaaggttatagtcacaagcaggattccaacctgggcactgagcgcaaagcccatgtacttgaccacatggtagaagagatccagggaggccaagtgatttgtcagaagtttcagatctgatattaaattccacatattttaattcatagcaagtactttttccatgctgtataattactcagtatctttcagtagtttcttatgacctgtccaagatattatttatagttacagaaaagaaccagttgttttgcttggaacttactatctggcagcatgagcactttgtgcattatctgttttgtgtttaaaacacatagatatgcacagaaggagggactggaacacattcaactaacttcttcctgcacatttctggaatgctgtttctgctgttggagaacgtgaacataaagaaaagggcatgaaagaaggagtctaatggcataaatacctacaggaaaatatttctgcctataatctttgcatttggtgctcaggtggcctagtcaccctacccattgattccaggaaaacaatcaggtcctctggtctatttataaggaaacaacactttctgcccaggcaagcttcttaagaaaaccaccaaagccagtgacagctgccaagaccattcttggtgctgtcatttgtatgctcttttcccccatcacatttcttctaacttagcatctgcttttcctgagagattgagaaaggcaagatttagttttactcttgagagaaagctgatactgtgtctgaaatgtcaagatgcctgaaaacattcactctgtcaggcagctgaacgcaggagctcctacatcccactgtgtttaaccactcttctcagcattgacaaaatacaaaggatggtacgggcattgttcctggcttaatagagcttaccaactgcatgggaagacaggaaaacaaacatagaagaaaggatcaacctgtggatcagtaactgtgttctgccaaggggtagagtggcctagtggcttgagcagggactttggagtctggtgacccagggttcaaatgttgtccctgattctcactagggtttgacctcaagccctgacttctctgtgcttccatttcctcgtttatgtagtggggggaaataacacctacccctgagctgttaagtatttgctatggtaaattatacttagttcaatactgggcacaaaccaggcactcacaaatgttagttttcttcttttctaaaaatagtgtaccaaaattcagacttttgtattcaattaagtaatttaattgaatccaatacttgttggtgcctactgtgtgccaggcactgtgccaggcattggacatataatggtagagcacgccaagggtctgccatatggagccataaggagatcgaattccactgctgctataaatggtccaaaaggcctgagcacagcacacacagggaggatgcccaacaccatcctggggactcgggaaggtttcctgggtgtaacaacaatgggaaggggaagcctattttaggtgatcagtgcggattgatacaagatgctaactgagctaacaaagcctgattttcctcccattttgcccctgtttgagcagaggtggattgatactgttggggcttgaagcttttacagtttgccagtcctctttaaggaaaaagatacacaatgtctttcttatgaataagtgacagaaagcaggtgaccatacaaacacattgctaaagcccacttggaaggtacccaaagcctaatctttaatcagcttcatggaaatccacctctacttttgtcgaaaatttacctgtgattctatagggactgacagacacatgtgggagatgggaaacattgacaactagtaccaaagagcaatgtacagtggaacatgcaggcaaagatgtgtgaagacagtgggataaagaagaggcatcggggcaggagactggatttgagacctctctgtgtaaccttgggacaaatgacttcacctttctgggaagcagttatctgatctgtaaaatgaagaggatccactcaactgaaaaaaaaacaaacaaaaaaaacccccaatctggcattcagtgatccctaatgtgccacatacagctgtgtgtggtttataggtagtgagttatctaatcctcacaaaaaccctgtgagatagatgctattcttgtctttagtttacaaatgagtaaactgaggcatagagtgtgtgaataccttgcccagggtcacatagacaagaagtggctagcagatttaagtatggaccacctagctttggagctttttctcttaatccattctgctgcaccctttctctataagtacaacatttgagtaattgctctcgaccagccactgtgcatattttatttgcaatgctggaaattttatttttaacctcaaaatgttggtattaatattgctctttataaggtaagaggaaaccaagactcagagagtttaaataattcccccctggtcacataactctttatactgcttatagagtaacttcaagccttataactgattaaaataataaatcaaatggtagccaacaatcaatggaggaaaaagtttttccaggaatacataaggtaaaatggacaaatcatgacattatattccatccagattaatctctttcatgatcctctagtcagcccaattcctacaggacttctatcccaagactgctaagcagctctcaaagcttctaaaaattcaaataccggccgggcactgtggcttatgcctgtaatcccagcactttgggaggccgaggtgggtggatcacgaggtcaggagtttgagaccagcctgaccaacgtggtgaaaacccgtctctactaaaaatacaaaaattagccgggtgttgtggtgcacgcctgtaatcccagctacttaggaggctgagacaggagaatcgcttgaacctgggaggtggaggttgcagtgagccgagatcacgccattgcactccagcctgggtgacagagtgagactctgtctcaaaaaaaaaaaaaaaattggaataccatagttttggtaacagagaacggcagttctgtgtaactgaaatttcaggtaagtaaagcttcacattatgagaactttaaaccaattaaatcttttaatgaaaattcttctaatatgtgctgcacatttgtttatcataagggaaaaaaagaacatgaaagataagccaacttgacgctcaggattatcagcatctgatgatgttttctgtatacttggttctacttagtatgttttcttttctttcttcagtgtcaaactgtccgtcttcatgtttctagctgctttcctttctcattctaatttttagctttcattaagtttcttttttcttataaaccatgttcattgtcatttgttagccaagttgagaggaaagtggctcaatatgtaggtatgaagatcttttaaattagtatgcatgagctttgtagtaggggcactggggagatctaatttagtctcacagaagcctccctttgcactgttttgtaatcttcataaatttaccaaccaaaatgtttaatctgcctgaacacattggtgttacttttatattaggcctattctagacttacttggttctaaatccccctaagacaaaaatatcacacagtggttttgtgatcaagaatgggccccaaagccaggctgtctgagttcaaattatggctgtaagatttgtggatattatgaccttggacaagttaattaacttctccatgccagtgttttcatctgtaaactggggacaataataatattttgcttatagtcttatcgtaaagatgaaataaaatgatatttacaaagttcttagcacaatacctggcatatagtaagtactcaagaaacaaatcattattatttctctcaacagcctttattttatgggccaaacctatttaacgccatactttctgaaatagcaagtagtagtactttttttggtaaataaattgccagtttgcaggcaggtatttatatgaagaacttcaattttggtgtcctgaagtaatgatatatacaagcatattgacaaggtggcatatcttctggattgctctctggatcacctggattgctctcaccaaccactggtaaattttaatatgcccaagtgcagtgagctgtgttgttgaggtgtttcctggtgttttggagccatctatgcatttaaatagagtcatcaactgcacaggaaaggcaaaaccatacagcttatttattaaatgctcataaaattgatgccctgccctagagcaaaacaattataaatcactggatccacagagagctgtaattcacctattgggatatgatttcctcaggatattgcctactgatgtcagcagcttctggtctaagatgtgagctgtgtccatgccaccaggtcacctgtagttatttttctattgattcatttacagttatactgaactgaccagtttttctggcattaaacacagctactcgggaggctgaggcaggagaatggcgtgaacccgggaagcggagcttgcagtgagccgagattgcgccactgcagtccgcagtccggcctgggcgacagagcgagactccgtcttaaaaaaaaaaaaaaaaaaaaaaaaaaaaaaaaaaaaaaaaaaaaaaaacacagcttaaattcggtgcaaattaagcatttaattaccccatatttatttttcaagccagacttaagaaaaaagtacagcatttttctagttggatagtacttattttcagtagtaggcatattcttctttttccttgtgcttttactttcctaacactaattttgctagtcctgaacattgccactgtggcagctaaacagcgagataagagatagcaaatgtgagcatcacttgatacaaatcactttgctgaaggtgctgatgcatatgaagggaaggaaagcaaggtctccatcttgttttactatctctggagcaactaaatcaatttaaaaatgtttacaaagcatcggggccaggcgcaaaggctcacgcatgtaatcctagcacattgggaagctgaggcaggcagatcacgaggtcaggagattgagaccatcctggctaacacggtgaaaccccgtctctactaaaaatacaaaaagttagctgggcgtggtggcaggcgcctgtagtcccagctacttgggaggctgaggcaggagaatcgcttgaacctgggaggcaggggttgcagtgagccgagatcgtaccactgcactccagcctgggcgacaaggcaagactccgtctcaaaaaaaaaaaaaaaaaaaaaacagtttacaaagcatcgtgtgagaaacaatagagaaacaacagaaaagtacaaaggagacataaaataaaaaagagttgaagtaggtaaagtatgagacagggttttggagaaaaacaaagaggataattttagggagtttaatgattttacaaaggtgtgtgcaggcttagggaagtaataagggaagatgcagactccagagctagcatcagagagtcattaccacccccttggactgaagggaacagagaaagagcagttaggaaagacctgtagctgtagtaataggagaaggacattacattagagccttggccttttagaacacagccactgccaatcagtagctcatcatggaaggggccacagatgccttggacctctcattcatcccaccttctgatctcttgcctgtgcttctcatgggttgaacccaccttgaggttagtggaacagggtggcaactgctctgttttagcagttcacaaaacttagtccccggagcacagggtagggtgagatttggtaaggagtggatctggaaagcaaagaaacatatccagcacaagaaagaagggctgggattcagagggtgccttccgccttgccaggctgagcacgctccctgctgcctgagcaaggttcccacacaacaacagccgacccacactggcctctgacaaacatgtttcctccaaaagataagtcaatctgttttttataaagggctgggcatggtggctcatgcctgtaatcctgacactttgggaggtggaggcgagaggattgcttgagtacccagaagttcaataccagcttgggcaacatagtgagacctcacttctggaaaaaaaaaaaaaaaaaaaaaaaaaaaaggtgaaatttatttaattatttatttaatttttaaaaacacttgaaaagaatattacttgttataattaaattcttctcactcttttggtaatctggcaggtggtagatttttttaaattttttttgttggagatggcaatcctccgtcaattacccatttgtatttatttattaacattattttggttttggaagcccaaatatctgggattcagtgatgtggagggtagtatagacgcccctgggctatgtatagctggacagtataaaggaagcagctggagagccaggcaggggctgtattttagtcaaacaactcctggtgcagcttaaagcaccagacatttatgaatgactgcagtgtgctacgcaaagtgctaggccatggaggagagggagccaagagtttttaagcttcctatcttctagtaacttactaaataatgacatagaaacaggcgtggaaataaacaaaagaccagccaaatgagaataggcttagctatagcaaagggatcagccaccatcacttgcattttggcagagactcaaaggcaagcagaggagtgggaaagctttataatggaaaaaaggggagcgtttatgtatgccctggttgcaggctgttagcatggggaaactgtaggcatgctaacaagaagtgagacatcctatgttattggctggtggtgcatattttgctttctttgattgatcctaaattggaagcagggacaaaaattggggaagctgtcagtgattaatcaagtcctggaccttttgggaaaattattacaaaagtttttgctaagcctccaagattgtcactaattagagcagtgtggcttcccgcaagtctgacttctaacaggctggctttcctggtgtttattgtagataaggaggttggtttcctgggaaggttgctgcaggttgtgggtcaaagttctgcttttacatgtgttctgggtgttgtctatttgtacgttgagtctcacaaatatacctaactcagaaccaactttaataagagcagcaagagagatagcacaagaaaaagtaaagggttttgggtgtctgatagcttggctctaggcaagttattaaactctgtaatgcattggttttaattttctataaaataaggataataatatttgccttgcaggcaaaatatatttggcttgtagggctgttttaaggaattacctaacatgtgtattgtgcctcttttggtgttctcatattttttgaactcatttcacccttaaaaactattgaggtcatcaatgaccttgtttttatgtgggttatatctactgatatttaatgtattataaattaaaatgaagaaaattaaaaatatttattttcattttaaaataacaataaacccattgtatgtacacataaagaacatattttaatgaaaaataactgcattttgaaagacagtacaattagtgagaaaagtggcatttaaaaaaatctcattatatctggcttaatcaaagacagctgatttttcatatctgtttccttattcaacctgttgctgtatcacacatcatgtaacctctggaaatttccactgtacactcatgggagaaagacaatgagaaaggcaaataaaaacttggtattcttgtgagagtagttttcaattcagagaccctctgaaagactttaggaaccttcagaccacattttcaataccactgctctagaccatagaaggcactcatataaatcattaataatattagcagaagactacagcagtgttggcatttatcacaaggggcacttctttatagaggtctgtcttgataaagaggccttgttgttgtcaatgattggaaaactcctatatgctggcagattaaaggcaggagatcttctgacaataggtggcttccctggaagccaggtctgaggctcaggacgaagagtgcaggtcttgcaaatgaagactaaaccagagagaagttcttatttttcagcagtatctgagtgagagaatgagtaaatgaaaacacaaatacacaccctttataccagttattttcaacaatatggcaacagcaagtgcaaaggactggaaaataggtcctgtggccccacctcactgctcaaatctggctcactggagcaacagtcttcccagttctgagaagagaggcaggtgacaaatatgatgaatcctccttcctccatcctccatttgctttacaaactgggcaactgagtggagaagccattgggttttctggcaaaattctgaaaaagggagcatagctggtgaaaacaagctcctggaatctgaaatcccagtctttcaaagtttatcagaagctaaatgttcaattacatgaagttatgcatgactgataggctaatgtctcaaatatttaatggtatttaaattttaaaatagtagtttgtgaagcaaaggaatgaatgagctttcagcaacaagttaaatcatgggtcatcttccctggactcttcagattagagtccctgtgtgaaggctgactcagactcacaaggcatattattgacactttactgtaattgagggggagaaatggactgatataaattatttcattttaattaaacaatggatctgtcctcctactataagaaaggaaaaaggtaatagttttgttttttggggtttttcctctcttcaaattttgcaaagcaattaaccttcaggttaagacaaaactcagaatattttatctctaccacttaatttgtcacaaatttacagtcaattggaaatataataaaagagtgagaattgaaagcatttttcttactttgctgtatggctagcttctgcaaatgctgtagcaagttctgtacatgtggttttgagaatgaaattctaaattgagttttataatgacataaaggctgaaagcagagattaaaggagagaggcttcttactcagagactggtgaaaatccagatctgctgagacctttcagcctggccttgatggtgacacatgaaagtgattctacagttgggaggcactcaagtttgcagatggcctgatctcacaatatgagagagattcacatatgaaagcaaccagacaaagaaggctgtagaaactagaagcctgggtgaacagttttttacgctggggtttatcagaaccattgtctcccagaggagtgtctggtcaataattttaacataggaaccatggtctctacagacctcaaagtgtggtcccagagtcagtcccttgtcggaatcacttggggaatttgttataactgtagattttgaaccccatgtcaagcctactgaattcatatctctctgtaaacagaagcagggaatatggatttctaataaacttcccaggtgataactgccattctgagaaacagttcatcctgtcatattgtgtctgttcacggagggctgaagggaggtctacttcagtctataaacattgatgatggatcggggaaggggcagaccaaggtctttttctcagacctccttctgttttctgtagccagataacagtcttagattggcccaaatatggcagcaggctgtaggcctattcttcgagtggctgtggacagagggtatatgtgcctggagaatagcatcaaagcttaagagcttctgacatactgtatttgacaatggttctacttgctctttcatccccttctcttctttccctaccagcctattaccatccccttccctctctccatgactgaatacagtcccacttctgtctgattgctaactttgctttggattctttctctttcctcctattcactacattcttagctattgaagtttagaagcattttctctccattcaccttcatctcagttttctattctagtctctgaactggacatgaagcaaaatgggaggttctaatactatctctgtctcaaccaaagagatgtttgtctccttaagctttttggcatttcccacagtgatttgcaaatttctttttatgtcatggagtcatgtctttaaaggaaggcatatggaaaattccaatgactagagggaactgacctgttttcagcaggctaggaagcatacggtttcatttcttcaacttcccaaccccttacctagaggaaggcagagagggctcatcctggaaaaccattgctctacaacatcttttagaatgagggcagaagaacctacagacacatctctggcagactccatccatggggtaagcccctttagagatggcagatcttatggaaagagcccataaagtctcttaaaactagactataggaaggaaagtagagggggaggcacaaacgtaaagacatctagcccacagggaatctgccgtaactctaacataacttgtgtatttgtgtgataaggattcattagtaaatagtgccaggaaaaacatttaatatggacattctctccaggtagagaagagaaaaaaattgagatgagaccaacagttaaaactttccatatctgaataaaagtcatattattaagagatacatgaataatctatcgttcagattttgatttttcttaactgcctcttccactaagttatatgggctcctaagggttatgggctggacattatttaattcaggagtctcagcatctagcattattggcccacaggagatctcagtacatattgaattaatgaatgggtatagtaatatctaacagagttatgatcatgctcgtttaccctatacatatttacttgttaaatttgtttgtttgggccacgtgtggtggctcacgcctataatcccagcactttgggaggccgaggtgggcggatcatgaggtccagagattgagaccatcctggttaacacggtgaaaccccatctctactaaaaaatacaaaaaaaaaaaaaattagccgggcatggtggctggtgcctgtagtcccagctactcaggaggctgaggcaggagaatggcgtcaacccaggaggcagagcttgcagtgagctgagattgcgccactgcactccagcttgggcaacagagcaagactccatctcaaaaaaaaaaaaaaattgtttgtttgtactcctaaattttatttagatatttttagttctcacaatcatcactgttcttctttcccattatttcaggagttcaggttgagggatatttattcacaccattgaaaagtttaaagaaatattatacagggaaataagatcacttgggagaactctgccttccagaagcaagtgtagcattctggttaggagcacaggccctgatgtcaaactgtctgggttcaaatgctgaatcagctccattctagaggcttcctaacttctctcaattctagtttctttatctgtataatgggcatattagaatatctcccttatagtatggttatgaggaataatcaggataaaacatgcaattcatttaacacagaacctcataaatggtaagactcaagaaatattagttcttgttattatttgtggcttagaccaagaaaaaattcaacatccaatctcagaaagttgtgttttgccactttgaaactttcccctgttaatataaaactactaaatcagagtgccccaccatcaccacctcaggtcacacctccctgactctctccttgagaaaaatagaaagttgtgcaagatgcctcccaaatattataaactttgggccccacagaacctgggtctgtggcagttcccaagtcagtgggggagaaaagctgaagcagtgtagtaacaatatattggaggttgctgatcctcttcgcagaagaagatgaagacttatttcaagatgaagacttttaattggactaaaataaactgatagagatagtgaggtaaagacagaatgtgagataatataagcaaaaaagcagcactttttgatacaagtgcattattgaattcaattaactaaaggtaccacagtaaggttgatgtttgatgtaaaaacactcaaagaggtgacaagaatattttctgtccagtgttcagtgagtgaagggataagtcatcagagctatcacgtgtccagagtcacaacactggaatacccatctagatgtaaaagttatcagctctcctctgtttttcttgaagacaaagtgggaagagatgtgctaaaatggcaaaggaaaagtttaagatcaaatgcataaggaagactgtcttgttttgtcaaacatgggaagttacatggggaggttgctgtccattcttaatgggaactttccaaaggaatgcattttaatctgggtgcaatggtgtaaagaaagaaagcagtgaattggtgacttataaaggctcctgcctccaaaaaaaccctttttaaattaaagggtgtcatctggcacacagaatagttccctgagcttacaggaatgatttctacagatattttttagccagacggagaattgtcatcctgggagtcaaaatcagactaattttttccagacctagaaacctcctgggacttggctagtgcaggtgcctgtcaggaccagggtttgtacatcgtcagattctttcttcctcctctagccccagaggctgtgctctagagcatactttacctctagagtagttgtcccctgagcatttgttttctttcctgacacaggaaggaagataaatactgttctgtcacagtttgagaaggcagtccatgatcatgatatagctaataaggtgctcaggagggaagagttcactagatggtggacaacgcgtggtgtttggtaataggagatatatgcaaaatttgtgttaacaggttatttaattctggttactaatttatacctgcatttgggaagtagagaaaagaacacattgaaaatcactgagtatattaaaaataaaatgctgtcaaattaggaaagttaaagaacgggccaaagagaatatagtattacattaattacctgtttgactcattgcgctcaagccagcaaacttgaggcagctgaaataattactgtatttattattttggctccaccccagcttgaaaaccaatccttcttggatgaagagaatatataaaatcaaaacatacttgttcacctgctcagtttcaaagagatcttctgtctggtcttcctggtatcccaatttcctagaaactggtttccctgttcttctatcccagctctctagtagatgggttcctgcccaaatgtgcttccctagtatcccagtccttttagaaactacattcctgatgtgaatgctaatctctgtattcagtttgggttctggtcaagtatccatcataactggaacgttgaatcctgtcttttgactcatgtcctactgtggatgcctcttgattagccatcaccttgcttttgcatttctgcccctttatttacttttgccttatttatctgcctgcactgtgttcttgagtcttctgatttgactccctatatcccagtccatcgtttggattttatatccaccaaatgctttctccagtctattttcaattatgttaatatcattttgccagcctcctctaattagaaaagaacaaataaagaggaacaaaatgtgcctgaccaggatgaaaaataaatcacccagaaagtggtgaatcataagccttggaattgtctccttttcgttcccgaagaacattgttgcaatgagaaggcaataacagaccaccaaaaagataggaagggcatatgagaatttcaatctccttatttttgtgatgtcaaggcctttcatatgtgtccttaaagttcctgcatttgtaaaatttttgcatattcaatacatcacataaaaaattttggaaaacctgatgaggagcatatgaaaattggaagcatgaataggaaagaaacttttaataataggttagttatttgttgctgttgttgttaaattcacaattagtggaaagtaaccatggaaagaatgggcatgttgagagagcattatcattttttttttatttcaaagaactttttttttttttttactattcagtttgaatggtttaataatctcttccaattccccatccctgatgtcacaaaagtgtcatatttggaaaaccaaaaggtttaataatcttttagtaagcctttctggcttcctgaactcaagaaagaaaatcaaacaaaacaagtgttgaacattcaagctgtattctgtaattttttacctgcttttcttcttcctttgttcttctgtcttcctctttccctttgtctctcctgctatcactcactctctctctaaatgactagatattcattatccggatatattctgttgctggaacagtaaaagatctgtgatttctatccccgaagactccagattttttctgggattttcctataaaaagacttaactgaagaagaatagacaggatttagagaaactctttaaattttggatatactataagttccaaaattaatatattcctttgaaagataaaaatttttaaaaggaaaggtggaaagacagaaaaagtagttggagctacccactcaaggcttagtcataattaactttaatactgaagtagattttttggaaagatgattagctttcattagtgttttaaaagtacatatgttcattgtagaaaatgtgcaaatacaaaaagtagaaagaaaaagacatcactggaaatcttactacccaaaggtaactatttggcatacagctttccgatttttccctatatatatgttccatattttaaagaaaatatacatatgatatcaccaactgtgttttcacatatatgttatgaatcttttctaaaatatttaaatatacattgaaatcctggttataagtagcaacacaggagtaatttatttaagcaataccttattactggcttttcttttttcctgattatttttgtcattataaataatgataattttcaatggtataaatacctctttgggtggataagtcccagaaaatagaattttgaggttcttacagttatgttgcctagttgacatcctaattgctgtgattttacacttccaacaagagggcatgagatgcctatttctttgaaccctgcaatgcttgtcataattattcttttgattgccagttttgaattcattatattttccctttcatcttttgaggtgtcttttcatttgcatttttttctttataagttactaacttttctattgttctgtgcatctttattttcattgatttgtgaggctttttcctcttataaataagcttgtttttcctgaaaataagcttttctaattctttgcattttgtttatggcatgttttggtcatccttaattttttttattctcatggagttatatttatcaattattttcttaaaaataaatgtatccaaaagacaagccatactaatgttaaaaccattataacattttctaaagtccgtgttattttataattataacccactttacaactcacatagatatatgttaggtgtgagtataatagaaacctcagcagactaagaacctgtagaaaagcaatgtcagaacagagaaacaaagttcagaattgaaaatagcaggaaacagacattatatgtcacctcgggcactgaacgtatgcaagctgtatatggatcactgttagaagctcttgaagcagttgacatcaacactaggaaatgatctttctttgttcagtagatcaaaatatagtaacaggtgtgtagcaggtgcctctgagttccctacaaggttccttggcctgcatctgatgttagccccaatggcagcgtgggcaggtctgtgcacagtcagcatcccacctcaagcacaccatgcctgccttactgcatttgccaaggcttttctgatggcacagctccctagatctacacttgcaagtgtggcctggaagtgcagtgccttgaaacactgccactctcacactaaccctcatctgatagaagaccagagccaggagataagttattgagtcttccctctttcgaatggacaattctggaaagctttctgtatgcttttcagataatagctgtactgaaacacccttgctcattgaaatgagtgagctaggaaaggagaaaaagacaatgtaaagatacattatcgatgaccttgattttttttaaagatacattatgaaggtatgcatgatatatctttacattgtctttttcttctttcctgtctcaccctccctgtcttagtcagcttgggctgctataggaaaatactataaacaagttgctcaaacaacaaaaattattttctcacagttctgaaggctgggaagtccaggatacctgtgccagcagattcagtttctggtgaaggctctcttcctggtttgtagacagctgccttcctctgtgtcctcacatggcagagagaggagagagagccctgatctctcttcttttaaggacaataatctcatcatggggaccacctcctcatgacttcatctaagcctgtttaccttccacaggcctcgcctccaaatgtcatcacgctggggattagggcttcaatatatgaattttgggagaacacaaactttcagtctcctcagtcttgctccctgttgcttcactcctttttcccagaatcacctcccaaataaaccacctgctcaccacaagttccctcctcaggctccacttttaaaggaactcaaattcaaatagtgtcttctctaaaacttatctgttaactgtgcttggatgatataaaatcatgttttttcaaagatctattttataattgtaaagatgttacccttccttccccagtgatgtttcattgtcatgaattcctaacatttccattctctttctttatccacagattctgtcaattaatcaatgattttttaaatgtactagggaagcttactacataaagggaatctactgcacacaggggcataatataaaagtgcagtcatgctgggtattcccagtgcctttttaaagtgtgggcttgatttctttcccagcctctctccaaccaacaaagactaaagagagagaaaggggagcagcctctcctggttcctttcctgaagtcaagctcattctggcctcttggaaaggaggaacttccagctgctggcagccaatatgtctgcctgctttggagctatttttcatgacctatatctctgccaggaaaatgaatgtcaggaatgtacatcagaacttgtaaagtaggatagccttcccctctgcctttcccccaaaccttacgcgtttaaaataactcggagtgtggaatgaggaagggaagattgaggctgactatgcaattattcagactatattatttctatttggataaacattgatcccacaaatgccaggaaagttggcaatcaccattgtagagagtgctccattaaaatttatgagccaacatactgtgaggacataattattatttataattacttccatgatgctcagtgctggttttgagactatcttgtgtcaggtggtatataagatgccactgaaatatctgaccctaaaaatcctctcataagtgtggccaaaggatactgaaatgaaacagtagaatagaaaatcagatgtctttcagagacagtgttgtcagagaaggtgtcttctgtaggatgctaatcacacttaacatcattttataaagaggacatcaattcttctgctgttaactggtactctagtgcaatattgtaattatactaactttccgatcatctgacaacagaggcttccaaaagacagttttagttgagttacctttttggtattttgtactcttgttttaggaataaagaaatacatatttttcttaatcagatcattccttggattgtgatttatcccatcaaaccaaccatcctggagccatgttcataaatgaactgctttagctgcttttgatctctcctgcaggctgactgtcatcacctgtcagcaacttcatataataagatctggtgtgctctgtcagtttgtatcagagcaaagttaatgtgtgagtgcaaaaagagttgacccctaaaagaatggaggtgtgctatgtgctggtgcaggctgtactcagtagtcaatagaatgcgtagagtctctgtaaatgtggtatttaaggaacaggctgttttcactgtgtaccgttgtttagtttttccaatcctcctgctgtggcccacttacgaaggagaaaacaagagagtgcacagaagcctgccaccatggtagctccgccagtgtgcgtggtaacaatttattttcatattggtcaaaatgttctaaataattttaacaccagaaatagcatggaaatggggaactaaattataaatgaaaaaccaggagaaatgctaaggatgggacatttcttctccatttctgattttttctttccaactggcacccatgatgggagcactctggcctctcttctactccttactcagcattacccagagtggcacatctgactagtgagttgggagagaaaacaaaacaagcaaacaaaccttctgcaggagtttgctgtctgctctgttcctcagggctgcaggtttcaggaagacctgtcccttcagcaccatctaggtggaccagtaacttctatgactggggagaagtctgtctacctctagggttttcacacctaagccgctgtctccaatgtcagcctcatctattaactgttttgttctttttctccactttttgttttaaaaaagagttattatttatgtttttttgtgttgtaaaatttctggaatatgtctgaccaatattggcttgtggcaagtgtagttgttaagagcacaggctccttgggcacataacataactcccttgtgcctcagttctcctctagaaaataaggacaatagtagtaacacctgtgcatagggctggctattgtgggtacactgcaccttgtctagcctaacttcctttctatgagccatttctattatcaagccatgccatttgcatgatgagctgcatttgctgtcagcctaatgttgattctaaacatggtgaactgttttgaaccattactgaactatagaactctagaaccaagtgagacttaagcaatcttagctttaggttctagttcaatggaagataaaactgaggcacccagacctgaaataattcatgggaggttgtacacggtagcaccaaagctggacattccatctgaccagactccagatctattgatttttcttctacctgagctttctttctctcttataactatttctgtcgactactctcctcacattcactcttccaatttaatgcagttactaagtctagtcaccaaccacattctacctacaagggattctataccaggcctcaataaaattttaagcattataaaacaacaacagtaataatagatagtgctccctgagattcacagtatatttttcctgttagagaaagctgagttgtgacttgcctgaagtaatcatgtaagaaaagcctactagaaaaacagtgctattgacttgtgatggatggtttttcctttataaccaagaacatttttaaagtcatatatgtatttcttgattgctcttttaacttcacttcttcctccctagagaactcactcttctgtttgaaacatcgcggggagtgcaaactaaatacagtattgaagtaaaatccctgcaaagctaatgaactattttatgtaaagtaaggcaggaaaccatttcagtagtggtggtgtaattaattggttgtggccacacagaggcaagattttagaaatgggcaatttataatagggatcttagaaggtcacatgtgatgaattgaaaggtagaaaatcattactttcaatcatgcatcaacctggaagccaaatcagactctttaatgtatgttttcaactgagagcagtttgcctaaatttcaaaaaggaaaatgtgatacatttgccaacagtctgcctgtatagctaattaccaattacatatcataaagaatctgatacctgtcatgttgtaacagatttcccaagcatggggcatgtggctgagcatactagcagataattagagtcataacagctaaaagaacattgtccttttaagctgaaagaacattgtccttttaagctgaaagaacattgtccttttaaaatcctcaatcttatttcaatatggaataatcctttttcagtgaatttaggataaatgacataagtatcagttggccggcttatttttatgcatgttcagctattctgattctggtgacacctgtggcatttatttttaggaccctagtaaactataactttttttttctttctatatagcttagaattattcttctatttaattatgtttagaagttggaatccattagctgggcatggtggtggacacctgtaatcccagctgcttgggaggctcaggcatgagaatcatttgaacctgggaggtgaaggttccagtgagccgagattgcaatactgcactccaacatgggcgatagagtgagaaactctgtctcaaaaaaattggaatccaggttaaattggtcacaatgttaccaagtcagaaagctcacaatgcagattgcaaaatactaatgaggacatcactgattttcatctatatcaaggtgtgtttaaattgctaaagcaatactgttttagttttagtttttgtttttgagatggagtctcgctctgttgcccaggctggagtgcaggggtgtgatctcagctcactgcaacctccgcctcctgggttcgagagattctcctgcctcagcccccgaggagctgggattacaggcacctgccatgatgcctgactaattttcgtacttttagtagagtcagagtttcaccaagtgggtcagggtggtctcgaactcctgacctcaggtgatccacctgcctcagcctcccaaagtgctgaattacaggcgtgaaccactgcacccagccgagcaatactggttttattttccacaaatactggccctctatgacataatatttgtggaataaaagaacaacaaaacattctattaattattttgtgagaaattgagtcagatagtagcctaagattaagaatatggattctacgaattggatttcaattctagctctgccacgtattagctggatgactgtaatggaattacttctctgagcttcagttgtttcttctagggataatggtaatgataccaacttttcagagtgctgagaggatttgatggcataatttgtgtaagatgcctagccccgtgcctgcatggtaggtggaagatacaaataactcataattatgatatctgagacatcaggcaccgggagaaaaagccagtcacttttaaggaaactcagttccattttagactgtaaagtttgagtctctgtggagtggagttgtcagtgggtctcaagcctggcatagaggtcaagattaaagattaagattttggagctataaataggttgaatcgagaatcaagaagaaatgttcccatcctaactatttctcctggttcttcatttaaagtttagctccttattttcatgctatttctggtataaaaattatttaaaatattttgtccaatataaaaagaaagcgttaccatgcacacttgcagagctaccatgatggcaggcttctctgcactctatctttttcccatccctaagtgggccacagcaggaggactggaaaagctaaacaggagcacacagtgagaacagcctgtcccttaagcagtgcatttacagagaacaaatgaaattctgatttggctatttcttggttaataaccaaaccgagtaattcaagaatcaagtaatattaatgagaaagtgatttatgatcaaagcagctatcatttgggaaacagaatttcccagagagtgtttgaggtagtggagacactaggaaaggaaaggagatgtgattcagatgaaggctcctgaatatggctacaaggtagtcagtagacatattaggatcattcagggtcaaatgagactgaacacatttccctctgtaaggtttattaggcttcagtgcgtcagcaagtgccaggggctgattattagcaccacagtatataaattgagagatcaccagattctaattttctcttgtacctctcctaaatgaatgtgtagagcatgtatttccatgaccaatcatgtgtctcacttctaatagaagaaaatatgcttcagatttacaaagatgcatgaaatacaactagctggaaatacagaagaaatgtagcaccaattactctttgagtaagataattgttggaagttttaaaagtgataaaaagtaagggcacaatattcattcatccacctacccacctacccaccgtcatgaacatccaccctttgccaggcatcgtgttcaaagaggaagaagataaagatctgccttttcaaaatcagacaagtgaaaatataagacagggtcattagtgtaatttgtgaaagactggaagtaactaagcagtggatatcatagcattttcatggaagagtgcaggaatgctttctggaaaaactgataacttccctgagccctgaggtcaagaacgaattaattgaagagtgaaggattggtgttgagggtcaggaatttccaggcagagggagcagaatgaggtgaagtggacctggggcccacagataactgggacctgactggtcaggtagggcctggaggtgagtaactaaggacactctttcccacgttaggagaggagagactgattccagaaacaaatgtcgttcacattcagtgttgcctattaggatttggacagggccataagtgggctctggagtgtgcgggacattctacccgcactgaacctcattattgacccttggttaaaagtttcacaaaaggagcgaagtcgaatgattttctccttttgggatatgcctgatttctattttggcttcattctttgagtgctaggaagcctctggagcaccacccatcctcatcccaaggctgagttaggggccccctttctgttctcatagcgtcttctctcactgcacctagcatagtgtgttgtaactgacacaaacagcttctatctcagtctctcgagaagcataaaacaatgtatttatttaatacctctgcatccttaatgctcggcacagtgcctgacacactaagcattgataaaggttcattgaaacaattagtctacaaatacatgagttagatattctggtgaattttaagaaaatctattatacataaggttttctcggtggaaaaaaaaagaaaacattaacagcgcaagcttcacaccagtaacccaccgagcaaagtacaatgttctctctaggcacttgacagactcccaggcctgctgtggggttagagtgagaaggaagaacaaacctttcactggtgtacactaagctccttcagatgggtggggagtgctgtacgtggagggcagggcacacagtgaaaatagaggcattgaaatcaattttgcgtgctgcccagttttgcctccagctttctgtgatcacactctctcaccacttgtgggggcagggaaagccggccccatgcatctctagggtgggttttagtgcattcattaaatggcaagaccagtgatcagtcatggccgacatattcaattaggagtcttgcaaataattctcctcaagctgccccttggcaccttctgctgtatagttttaaagtgtacagaatcagctaaggagaatagtaatcacactctatattgcttatcctgtgttgcaggctggaattattagttctaggtccacctataaagtatccagatatagaggcacagtattgcttgatccaatattcctctttagaaactggacctcaaatcaaatgtagatcctctgttttgaaaagctactggataaggcacttaagccaattaaaagtaaagtcagctctcaggatgataaaaatcccaacataacagctttgtagctacaaagatactgtattagtccgttctcagactgctataaagaacttcccaacactgggtaattttattaaggaaaaaggtttaattgtctcacagttctgcatggctggggagccctcaggaaacttacaattatggcagaaggtgaaggggaggcaagtttagaccttctcacatgggagcaggagagagaagagtgagaaaaggaggaacttgccaaacacttataaaaccatcagatctcgtgagcactcactcattatcatgagaacagcatgggggaaccacgcccatgatccaatcacctccctcccactgggcccccctcgacacgtggggattatggggattacaattcaagatgagatttcagtggggacacagccaaaccatatcagatactttagctattttttaataaactgaataatcattttctctctccaaaactttgagatctatactttggctgacagtccgtgccttcaggcagcctcacaagaatatctgagaacagacagtattgcgttgcatccagggtaagtaaccaccataaaattttttcaatgacacgttgaagttaacaataatcctaacccttggatgtaatcatgcacacaatctcacatgaacctgaattaactaaccaggtctccatagtgaaaggatccacgttcctttgataatgagtatgatgtagcactttgacactcttgttctctttacaacaactgtttggggttaaatcaatgtggttatcatgttttgaagatggaaaacagctgaataaaaaaatgtgacatagtatagggaatataatatcatttttagattataaaaaccacagtttttatctaagttttgaaatgaaataattccatgggtataagctgatgactttgcttccctgggccacagtttcctcactggaaaatgagagctaaaactaaaaagtcatgaaagtccttctaagaaataaagtccactggttcatggagaattctacatcctaaagttaattaacagaagaccccaggttggcctccctaattgcgttttaatttactttttctcagcacactgcttttctagtagtaatgattttgtttatttacccatccacccatccatgcattcaacaaacacttattcgatgagtcccgtagattctgtgctgtgtgtgcaaagatgaacaagactccctgcttagtgtcttctcttagagagatcacaatctaatatgtgattgcttgggttttgagtttgtgaaatgagcttctcaatataaatggaaatctctcatagttttctgtaacgtaaagggaaatcatgcttcaaaatgtaatgaagtagaaaataaaaacaaaatattctcctgtttcttgaaaagattttaccacaagatctggaaacttgtttcttgaaaagaacctaaaggtctttgtggaatatttcatagcctctaagagagacaagtctgaacttagaatttgctcatctttatcagtgtaaaatagatgcattaaaatactcaagtattttatgccatatttttatcagagcaagctataaaagatacaaaagatcttaaaagatgctataaaacctccaaatctaaggaggttaatgcaataaaatttaattctgagtcatgtaaagtccaattctgattttctcctgggggacagttctcctgagcagccccatggggcttctgtcttatggcttgtggctatctcaaggcttcatcatcctgtagcttcaagatttccctgttgttgggaaaatgatctcacacccagtgcttaatcaccgaggttataaaccaaacatcagtttccttcacattccttcggcaagaactggtcacatggtcccaccatgctgaaaaggaagcctagaaatgtcctggctagacagccacttcccagtaaacatcttagttggttatgttatggtaaagagttgctgtctcaagtcccgcaattgctctaccacctgctggtccactgggagctcctgaacctccctacggtctggtgaccaaatgcccaaaactaagtaggatctaagacattgtttcaaagttctgcctggaatcccttctgattagttgatgcctattcagtactgattattaaatatttgacatagcacgtcagcatctagtatctttgcaagctccattttccaaactcactggcactaacttgcttgctgtggtcactgacctctaatttcagatctcttcctttggacctgatgattggtaccttcctgaagtgcttcatctttccttgccaggatacagacctacttctctcaaaccctcacttaaggcgacccatctccaccttactgtctgcccatttcccctcccaggtctcttaaccaccccagaggagccccacattctcttaaccaccccagaggaggctccaaggcacccagaatcttcataatttccctttctgggtctcttactgtcacgcttcaccaagcccgacaagctcttgtctctccctgcttacgatttccctctcagtcttcctcccacaaagagagattttcatccccacctcatcgaaatctgggtgaccaatattatctttccaggaaactctgaactctgtagccaaagcagtgaacacatctctgctaacgttttaatggtctgcccatcacagacagcacatttgcctgacatctggagactgctgaagataaagccttagctcaaaaagcagcactctctgttgttttttcaggcactacagcagcatcaaactgcacttttcctcccctgtctatggtgacctctaattctttcttccttgcatttctgactttctgcctttctgtttataatttacaatttatatggaaagaattttcaacatctgaccattacaaactgaaagaaattgcataatattgctcttggacctagaattaagtgggtttacaaatcccaactcatgtagccagggaccttttaaataaataaacattaaatactggctttgtaccagttaacattttcttaaatatgatatgagggtttctaactctggtctccattcaaatttaagatgcaagatatatatttggggctagtgatttagtaatatcaggtaagagatcagagtctatgaagaaggagaggaaataagagaaatgaagtgagacagtaaaaagagggaagggagagagaaggctagcatacagaaaagagtagcagtcaagaaacttgaaaagaacaaaatgtaaaattctggtttttgaatgatgaatgacaaataataatgaatgaatttgcaagtaatacggtttaactggttgaataaggagaacccctcagaatttctgatacatgtgataattggcatacgtgtgctaaacattatcaatagagcatgatggagtcctttcatacctcagtttatcagctttcataattatagttgtaaattatactaaggaaactactcctgtataaatacatatggtcatatttgctaagcctcttttatcatctctaaaggtgtatctgcagatggtttgagtccaggcttttaacagccatgattccccctatgaattactgagaattggctaggaaatttctgagacttatttggtaaataacttccacaacattcttgtacattccggtaagaaaatatacaagtctaaaagaccagtctcaagggcaaagaaaaggggaaaactaggacctgaaatagaaaacagctttgaatgtttttatcaagcaggatcactcattattcagagaaatcactttctctgtgccaagactgaactgggcatttggatccataggagctaggtaatgtctttgcaacatttggagcctgtaatgtgtcactgacatgagaatattgaacttgggcaaattagaccctatttaaaatcaggttgtttctattcactatgcaacctgcaggatcagcaatagaagtagcaaccccagtgctttcacataaactatgtcacatcacagagttgtgaggtagaaatgctgatctgcactagctgtggccacagtaccattgaccacttgcttaatcatgactgacactgagtgtatttttctagcttcctatctctttttcatgttttctgtcaccattaaatgagtcaatatttgaaactgttagtggttctttggatcagttgtctttaaagtgacaaggatggtggaggtgatggtaatggtagaggtgatattcactccagggggtgcacgagataatacattagcatgaaatgttagaaaatctatttatactattaaaatctatttttatgtatgttcttttgtttgcacatatttctgatattagtacagtagtaatatataatttattatgtatgcatgtgtatgcaatccaaataaaactaagcattatatggacttgatttcaacttcaatgaatttatttaattattcattcatccaacaaacatcgtttagcacctattttgttccaagcactatgctgggcattgagaatatgatcgtaatcaagataaacccaagtcctacattcagtagtagagtcggtatccactgaggactggttccaggaccacccccatccctataccaaaattgcctgatgctcgggtctcttagataaaatggtgtagtgtttacatataacgtacgcacatcctctgcatactttaaatcatctctagattacttataatacctaatacaatgtaaatgctatgtaaataattataatgttgtattgttatttgtattctattttattgttgtattattatcttttattggtttctttgtcctgaatattttccatacttggttgtttgaatccatgtttgcagaactgatggatctggagggcaggctgtaattctaagggtgataagtgctatgtaatcttataataggggcacttggcctagtctgcgattgggagctgtcaaggaaggcttctgacttattattcttgtatagttttcttttcaagttggaaaatattttacaatgttctctaaggaattgtcccataaagtatagcatctacaatcaatttatattctctaagtatatggagcgtctatatacttagagaatataaattgattgtagatgctatacttagagaatattaatgatcaccattaatatagtgtctacaatcaatttatattctccaaggaggagaaacttatctttttttcttaaaacttattttttttcttaaaatgtaatgagttatattttttcttttctccattgtctactataaagatgaaatcattattgcatgaactgtacagtcagaagtattattatatctaagcttagagcaggttgtccagaggctgctattattccaccagggtataacaggagagatgcagttaattatacattgcaacttgcagtttcaaacctctggtactggtacatacacatatacacatctatatatttagatgtttaggggtttttatcttgataaaggaaaaaaaaaaaaacaagagaaaagatgaaataaatgtgttgatgacagtttgttaattctgtgccagtaccttggctttaattactgtagctttataatagtttcagtatttggaaggatactatttctctccatattgtttattgctagaaattttcctctattacttttccagataaactttagaaaaattcgataactttcaaaataaaaatctgttgggttttttaaaaatcacgttgaatttgcacgcaatttagggaaaaaaaagctatttttgtattattatactttaacttctaggatacaagtgcagaatgtgcaggtttgttacataggtatacatgtgccatggtggtttgcagcacccatcaacccgtcatctactaatgtagatgtttctcctaatgctatccctccccttgccccccaccctctgacaggccccagtgtgtgatgttcccctccctgtgcccacatgttctcattgttcaactcccacttatgagtgagaacatgcagtgtttggttttctgttcctgtgttagttccatctcacgccagttagaatggtgatcattaaaaagtcaggaaacaacagatgctggagaggatgtggaaaaataggaatgcttttacactgttggtgggagtgtaaattagatcaaccattgtagaagacagtgtggcgattcctcaaggatctagaaccagaaataccatttgacccagcaatcccattactgggtgtatacccaaaggattataaatcattctactataaaaacacatgcacacatatgtttattgcagcagtattcacaatagcaaagacttggaatcaacccaaatacccatcaattatagactggataaagaaagtgtggcacatatacaccatggaatactatggagtcctaaaaaagaatgagttcgtgtcctttgcaggaatatggatgaagctggaaaccatcattctcagcagaaaatctctattttcacaatattgtgatgaggtgttggtaagacatttatttggtgatggccactgaagcacatgagagatacaggaactagtaacaaagatctggacatcattagtcttgagctgatagttgaagtcatagaaagatacattttatctcaacttaaaaacaattatcatcaagttttgtgcatcctaattcccacaatcttctattcacatgtaatctacttatggtgcccattattcatatcataccagcagccttaagaatatacaaagtgttttacattaaataaccccagaactgaatcccaaaactataaaactttatattttctgactttctgactaatttaatgttttctgcattttctttttcttcatcatcaccttgctggcctaatttcttcaggtggcactttttgttagatgagctggcttagtctaagcatttgattttaaagcttagagcaatctaagggtttctaaagcattcttaggtccactactggactataatatatcatgtaggtaatgaagtattgcttggagtgtgcaatgtacccaagggaaatcatttttaaaggcagatattaaaaggttttcttggtagaggatttatggattctttccaaagagcttagcaagttaagttatattttaaatggggaaataagaaacaattacaaaacaattttactttaccctacaagattcaaatccaacttctcaactagattatatgacagagtatatatgtgattatgccatttaattataatttaaatgtttttaagtcacaggaacaatctctattacaaagaggttgcttaaataattacttatataattacttttcccatttttaaatgaaatcttcatatttagatgagaaaaatttcaggaaattcccattgtgataaaaagtcattataaggtttgtgtaaagcaagcagcagtgaagtcctttcatatcatgctctcactctctcttctcctctttttccctctctctctctccaatgtatcccaaaattgcatttgaaaatcttttactgtatagctgtctttccaaaaatgcttaaacatgtttgatagtgatgattcagactcatttgttcatgtattccttcattcaacatttattgggtgcctattacgtcccaggcaatatcccaggtagtggggatataatgtacaaatgcctcagagagcttatatttctgtaggtgagacaaacagtaagtgatgaaatataaattatgcacatataattttaggtagtgataaattacatatatacatactctttttctctgtacttataattttatttatgatagatattatacagaaaataaagcaggatacaagggacaaagacagacctatatgatcagggttgctaaatacacagctttgctctcatgcctccaaagttatgcagatcagcaagaagaacaaataaaccatctacaacttaagttctcatcataattaagatagcaagatacaaaacctcagggaatactttagtcaagttttcttcctgtggcaccaactaaaaatgagcctcatccagtcaagagatgaatgaggagtctttggcaaaaggttttgcagtgaccaatgaaatacattaaaaacaaagatgggacaagtgtggaagaattgtataaaaggacatgttttgacaatctagaaatagcaaacttaagaaatggagaagagacagagaaagataaaaccggaatcgctctttgattgtcgtgtaattgttgggaggcaaaggctctagtttaaggctgacaaaccaaatagtagaatgttaagggaactaagaactaggtcattatgaaaggtaaagagtaaaactaatgactgcaacaagccatcttaattaacaaaattttttttaaaaagagcaaggaaacattatttggagaattaaatatggtaaatacaatgccatggtaaatataacccaaaatattatgacagatttgagatcaagcatatttgccatatcaatactatatggtcacatcacctgttaaaaagaaaagggtttcagaatggctgacaaagtaaaacctaactcttttttttttttttttttttttttgagacggagtctcgctctgtcacccaggctggagtgcagtgacgcagtctcggctcactgcaagctccgcctcccgggttcacgcctttctcctgcctcagcctctccgagtagctgggactacaggcgcccgccaccacgcccggctaatttttttgtatttttagtagagacggggtttcaccgtggtctcgatctcctgacctcgtgatccacccgccttggcctcccaaagtgctgggattacaagcgtgagccaccgcgcccggccctaaacctaactcttacatggttgataagaggcacaccaaacaaagagacttagaaaggctaaaataaaggtatcaacagagatacgtaaggcagacgctgaccaaaaacaactagaagttttgatctagtttacacacaaagtagacttatagcccaaacctacagaatgggataaataaaacatttcataataccaaagacctctatttttcagcatggtgactataactaatcataatgtactttgtatttgacagttgctaagagagtagatcttaaatgttctcaccacatacacaaaaaataagtatgtgaggtgatggatatgttaattatcttgaattaaccattccataatgtatacatatatcaaaacaccatattgtatgcccaaaatgtgtacatttgtatctggcaattaaaaacattttaaaaaataaaaataaaaatgtaatgctaaagtcaataagtcacaataaagttatagcagtttttaatatctcgcctcaaataacataaacatgtttataaagtagaaatacacagaaacatactagtaatactctaaaagataggttaagtggataaaaatgaagtaagcatatacattataagaggaaatgacacaaaggtgaggagaggggacagagggtgactgtgggagtccctttagaatgagtggtcagggctcgactggtgggaacataaaccagtacaaccactatggaaaacagtgtggagattccttaaagaactaaaagcagaaccaccatttgatccaacagtcccactactgggtatctacccagaggaaaagaagtcattataccaaaaagatacttgcacacgcatgtttatagcagcacagttcacaattgcaaaatcgtggaaccaactcaaatgcccatcaagcaactagtggataaagaaactgtggtatatttataagatggaatactgctcagccataaaaaggaatgaattaacaatgttttcagcaacctggatgagattggacactattattctgagtgaagtaactcaggaatggaaaaccaaacattgtatgttctcactgatatgtgtgagctaagctatgaggacacaaaggcataagactgatacaatggactttgaggactttggggggaagaatgggaagggggtgaggtttatctaaaagactacaaatagggtgcagtgtatactgctcaggtgatgggtgcaccaaaatctcacaaatcaccactaaagaacttacttatgtaaccaaataccacctatactccaataatttatagaaaaaaaaaaaaggaaagagtattcggggaaggactttccaaagagatgacatttgagagagatctgaatgacgatgtgtgcatcatgtgaagattggaagaacaacatttgaacttagagagcagcagtacaatagctcttaggagagaaaagacctggagttctcacagatccgcaggaaggtcactagcatttaagcaaagttagaaagggaaagaatggcagatggtgaggtgggagaagcagacaagggccagaccataataggccttatatataggctgtgctgagaaggtctgattttattctaagtgccaaaggaatcctctggaggatttcaaggagaagagtgacatgatctcacagaatgtaccttcacacaagatagacttttattctgtttttctcttagttttatcccccctaaaactgctgttgtttgtccatgctatgctttttctttaactgctagttttatccttaacataaattatggaaagtattcaatgcaataaatctagtttgtgaaaaggcccatgaaaaatttatttttaaatgcaaaaagtaagccaccagaataaaaattagctacgtttttatctcagagtgatgatagctccaaaactaattagtgaaagaaggggacactgtatatcactgcacacttaaaaatacagagaaaggaaagaaagtttgggaagaataaaactgcttcatacgtgtctattatgttgcaggtatagtattagacaatttgcctatatcgggtcatttaatcctcccaaaaatattctgtgagattacattatccctaacttatagtaggacagactaaaacctaaacccacccagcgactttcacaatgttcatctgctaaagaagtgggaaatttgggatttaaacccagtcctgcttccgtattcaccaaggtgagtatgggaggaaaggactgtggttatcagcttgaggagattttgggctgagacgatggggttttctagatatgcaatcatgtcatctgcaaacaggaaaggattgtgggaaaggattgtggtttagaaatgagaaaggagaactttacttttaaacaatcaatagaatatgatttagcagcctactggaaattatgccatggttaatgaaaagataaaaacattccttattgtttgcatcagttatctcttacagcctaaccatggtaaggtttagtggcgtaaaatgacaatttccttagcctactattctgtgggtcagcaatttggactgggtttagctgggtggctcttctggtcctgattagattctctaatcatgatgcatctgtgatcagcagcagggtagcactacttctgagagttaattggctattgtctgggcagtggagcaataaggcaatggggttactgagccaagtgtatttcatcatctagcagaccaccctgggtttgtctagatgaagatttgccaaaattttgagagagggaggaagcatgcaaggcttcttaagatctagactcagaactggaacattatcactgtagtcatttgtattggccagagcaagtcgcaagtccagcccaaattcaaaggagtagggaaatagctgtcacttctatgacaggagagatgggagaagccacaaagtcacatcataaaaggggaatgaagacgggtaggttttgaaaatcatggctattttcgcaatctaccatgttaggcaaaaaaacttttataatcacacagtgaattaatcacataggaaaacaattctcaatactgctgtttgagatatatacatatgcccatgcatgtgcagatatgtaggtatatatatatatacacatgcacatatataaattatatgtccaaattatgtgtttttatttcaaattttaaaatatactgaagtgaaattatatgtcttcttctgaaagaggtaatgccttcactatatgctttttctttggttcctttgagaatatgcctggcacacaataaactctcaacagagattggatgaccagttatttgcaggcatcatgtaatctttttctccctttcgccccagaggaaaaataagcaatcttttatttttatatcactcatttgccaatgaaaggaatagacttcattgcttttctaagtagcagatactgtatccctccagaatctgaagtaagtagaatattcagttatgctcttgtgtttataccaagaaaacagttagttttctactttcctccagtagaaccaagcttcatttcccccactgattttcttatagaaaagaaagtaagtctgaaaacttgtcaatattaaactttcaaagaaataataaaattaattttttctcaagcagctgaaaaatggttgtaatcccctgaccatcagtcttatgatgatccctttttttcttaagcttgttttgttttgagacaaggtctggctctatcgcccaggctggaatgcagtgacatgatctcggctcactgcaacctctgcctcctgggctcaagccatcctcccacctcaggctcttgagtagatgggactacaggcacatgccaccatgcctggctaatttttgtgttttttgtagagacagcgatttggtcatgttgcccaggctagtcttgaattcttgaactcaagcaatccgcccgcctcggcctcccaaagtgctgggattacaggtgtgagccaccacacctggcttttcttaaattcctaatacagcaattaccttgggatgaagaaataaaacaaaacaaagcaaacaaacaaaaaatttaatacccccttcctatctatgcaaggtagatagatgtgaaccatattagatgattgcctaagcctatgatattttagcagtgcattatggaaattctaattgttatttcttgcctgggatttgaaaagtaaaagatgaaatagtccctgagactgacagttactatgtggtataaacttccatcatgagaagtataatatttattcttcttcccattcactcccaccccaagccatgcagaaacaacatgagaggacgacgtaaatagacttgcaaagatgtctcatcctgttgcctggagttggagggatatatctcatatattttccataccatattgtattttttaagaacaaaaatttggcaaatattctttattttgatctgccaatggcagccccattttatcacatgaatcagatgagagaaggagcccacattagtcagtgtaattaatgccaacaagatagaccaacgctgattagtgacttaaaggaatatatggttatttctttatctgaagcaggttgggtagcccttttgtatggttttccttgaagctcaaggctgcaggctacttccatctttcaagtctgccattttagattcctttattttaatcataaggaaaaaagagagagcatggagagggcgcactcttacctggcatggactgaaagtgagacctcactattgtcaaatcccattggcaagagtgagtcataggacccatctaccatggatgcttgaagctgggggaatgcagaggagcacatgcaaattaggtgggaactaacagcctctctcacacagagaggtatgcagacaagcttgattaacacggactctatcaaaatcaaaacatgataatgttcctgcctccccaaaattcatctcttattttaaggtcctattaaagtattaattgtgggtatttcatttctttcaggaaataaacatgggatattcattatgtgaaaaaaaagaaactagaatatatcttaaagtatagtcatgtctcatgggcttttcattagaattttgtgacctactgcaggtattattatactcagtaaaataagcaaactcaggaattataaatgactgcatcaaaatatcacttgaaatcatgtgccgatatctttttttcttccatggtatttctaatatacatttccatgtttataatatgccattcatagcagacagtctgtagcaacccaaaggaattgttaatttcctggaaccaaacattggctgcttaaagatattctttgtttacatttttttcatatttgctattgcatgcctgactaagtggctccaataatttaagggttaaagacccattggagcaaatgacaatgcagctgattgattagagaagtcctagatgaaatagatctagctttgatcaaacacacaagatctgtctctcaattgatgacctgcctgtatctagtgtggtggcaatgcttgagagcagggacactgcaagataggtcttaaaggttagacaaggctagtttactgaatccattaaccctatttctaagagctgctaattgctggaactattggccctgtcttacctcccttttccttagcttcctctgaagctcacatgatattattatgtatgcacactgaggaagagatggacagaggggttagagaacgcatgcaaaacagaatgaacagttgtaaaagcaaaaagaaactagaatattaatcatttttagtgtgagcaggaaaagacttagcagaggtaaatattcagggaagagatacttaatccttctcactgctcattctctcccacatcccaggtccttatttgatggaatcaggtcaggagtgatgagatcttttttagaagggaggtcctttttaatttagtcttttacatcagctcttgtgggaggtctcctttaggtcttagatcctgctcactctctctatttctggatagtggggaagaggatattgtgcccttttcttggaaattattagactctggaaggggcaaaattgtagatagagcagagaaagcagagctgactgctgccaatttgtcagagcccatggagacaggaaaggaggcggcagaaatagaggggtgtgctgttgttcaataatacaaaattatgattgtagagttttcttcatgctgattcctttcacagaacatgctgaacttgaataagccttacagcagattcttcctctggtgagaaggaggggttgaaggaaaaaatcatagtcatataaattatattatttatatccatactgatatagttattaaacaccaagccaagtatattaaaattaattcttacagcaaccacatggggaaggtattaataagaccatttatcagctaagaaagcagaagataaataattggcccaaatgtcgtatatcttataaaaaagatctgagattcaaatccattgagctggatgaatctcagaaacatgcaaaacaaagaaagccagacacagaagagaatataccacaagataccatttacatgaaattcaaggacagacaaaaagtaagctgtggtgatagaaaccagatcagcagttaattgggtgaggggtaggaggggattgatttcaaaggggtatgagggaactctttttggatgatggatatgctctatttcttaattgtggtagttcaattatgtttgtcagaacttattgaactgtatgtaaaaatggatgtcttttattgcatgtaagttttaacacaatgaaggctatgatcctgtcaatgttgtatcttcttccctcaaggagaatataagcacggaattgcttgccattgaagaaagagctgtttatgtttcttttgtgtcaataatataaatagtacttctgcatttttctagttaactactgaacatttcattgtatttaattaatagggacagaaaagttatgtctaaatatacaaagtatgcaaagtgaagaatccaggcattccttcgcttcttttttttttcaaattaaaaagaaagcatggtttagagaattaaaatattcaaatgattgctttaatttttgcttttatctgtagacattatatatgtaaagataaggctttgttgaccactgcctaggcgaccccactggcaaatgtgtattataaaattcataccaattcatatcaaagggatagaattagtagatccatccttgggcagacattctgtcctgtaaacacatttcaaaaagtgattttggataaaaatttctttatcatttgttgaaaaattaattttgatcatcttactcctaagaatttcaagtttaaaatattaaaatgtaactaaattcatttggatgaaatagaagggaaagatttattcaaatgtaactattagctaaaagtaaatgttacttgggcaaaagagctgaacagacacttgaccaaagatgacattcagatggccaataagggtaagaaaagttgcttatcatcattagttattagggaaattcaaattaaaccatagtgggataccaccacacacatattagaatggatgcagtagaaaacaaaaattaaaaaatgaaaacaaacaaaaaacggcaaaaagctgaaaatgataagaactggcaaacttgcaaagcaattggtggcaggagtgtgaaatagtatggccatcctgaaaaaccctttggcactttcttataaaactaagcaagtgcatgttttatatcttcttagtatcgtaatagtgctttgcctgtgataggctttccatagatgtattttagaataacgagatgaatgcatgacatttcattctattttacatattttggaatagggacctttgataagtttatttttcctaaaaccccatgaagtcatggaattacacttatagaaattcagcgcagtccagcaatcaattgctgaacatttatcccagaggaatgaaaacttacattttcatagaaatctgtacgtacgtatttataacagcattatttttaatagcttcaaactggaaacaacctagatttccttcaatagatgaatcattaaacaaatgtggcaaatccatactatcgaatacaactgagcgataaagagaaatgcactattgataacacagtaacctggatgaatcttcagggaattatgctgagtgaaaaggccaatctccaaaggtcatatattatatgattccattaatataatattcttgaaatggtaaaattatagaaatggcgaaccatttcagaatagcggttgctaggggtcaggacagaggagcagggaggcagtggaggtggctataaaagggcaacatgagtaatcaacatgagggtgatgggaatgctctgtaacatttgactgtatcaatgtccatatccaggttgtgatactgtactatagatttgtaagatgttaccattaggggacactaggtgaggggtacacaggatctctttatatcatttcttaaaactgcatgtgaatctacatttaattcaaaataaaacatttaattttgataaagtacattaaatcatgttgctctcctgcaaaccatctagtagcttcccataatatactaagaatccaaaactcctcaatgttgcctaataggacttgcaggagctggctcctgacgtcccttcccagctcatttcctactattctccctctggctgactttgctcctaaccacacttggcttcttttggtttctcaaatactccaaaggtgttcccaccttaggatcttggcgctggatgcctccagcctctgaaatatgtttctcccagatcatagtctagtttactccctcccttaatatagttgctctaacgtcacctccttaatctcactcccttaatgttatttgctaaaatatcacttcctgaaaaaggacttccctgaccagtttgtctaaaacagcacacatatttctgtattttctgatgagcaaaaataagtcggaaaagtattcatatctttatgagaacatttgtgtgtaaaatttaatgcacaaaaaaaatcattatatattgtttaatcctaccaggcaggtaagtggataaggcttttatgggggaatactgcattatgagtaagataagagataagtaatacctgatagccattagtgtttttgcagaaaatgtgagtgtgtgacctaagaaaaatgttttgcgtgcaaatttggtagcaacttctttcagttgcaatatagtttctatttatttaagtagtcctactgagaaatgagctgctatgtgcctgtccttatcagaaaacactacatcttgggctctaccaggaaacagaagactatttattagtaccaaagaaaggtactaatgatttcagattgaagtagtacaataaatggtccattaaatgctcttgaatttacgtgctttcattttattgctgttatttcattaactccttgatggacacttgttttggaaaaaatcatcttctcaatgcaaatcctgggactgcttctccttgaggtcattcaaactccgtgttactcattttctatcttcgtggtagcatcatagtgccttgcatgttaaaggtatcccatacatgtattttagaacaaagaaatgaataaacaaaggacatttaatcttattttacatatttaggaatagggatctttgataagcttattttctttgaaactcaatgaagtcatggaatactacacttctacaaatcctttaatgtaggagtcagtgggaaacgtgcatatctactgaggatcatgaaggccaatacactgcactaaaatattgagggacacaaagaacccttttattgcctgcactgcaaattcatctgtttctgcaatagatttctgtgaatagatgatgggctgtactatattttaattccttgcttctggcaggttccaacacacaggggtaagaggatgaaacaatagtagacagctataattatttggttagggattgcatagggtaatattcaatgtccctcaggaaattggcacaacacaatataattggctttattttattgtttgtaatgttcatgtttccccaagtcagctgtgctttatttgattgcactgagaccaaaaatatgtaaagtatttgttgacagagaaggtgaacaagctattactctgtatgagtggatagcttgaagtgttcacatctctagttttgccaagtgtttatattacagatatgttgaaaaccactgcgggggacaaggacagtctttctcaaatttgagcataaatgagaatcacttggagtatttgttaaaattcaagattcttaggccttatttccatagattctgattccagaggatcaaagcatgcaaaagatattgaatctctaacaagctcccaaacaatggtggttcacacaccacagtctttgtaacaccacactaggctgaccagttagtagagataggggctgctggtcacacatgtggatgaagttaggtggaaatcagctggaagcctgagctgcggtcagggcaggaaggcctgcatcttccccaggaagaaactgcgacttctctgaagacagatgatgaatgtgaagctaattatatgggagttgactcagaggataatggagatgatttatggaaagttgtgctacaaaactgggtggaaatatgaaaacagcagtgaggtgatgacgtgcgtgggacgtcagaccagagccaaaaatttcttttattgcatctgaacatttgagcgttttgtcctggggagacaaccaattgccattaatgttggaaaacaaaattatctgatgcttttagacagactatgtgaagtgtaaatgaatcatggtgatagttgtggcagactctccaagttgctttcccaatgtcttttcacccctttaccaacagaaccaccatatcatatcaattggaaacaaatgagaattggttttacgcactgatgacactaacaatgggggtaggccttactgagcttggcaatttgcccagttataaaatttgattcctcagcctcctttaaagctgcatagatctgcatgacagagttctagcaagtgagagataaccagagctctactaagcaggcttctgggaatctattgttttcctgacttaaggaaatgaaagggcagacttagctgcattgcaccctttgctatttcctctccctcctttcctggaatgtagttgtaaggcctgggtgtgtaggagccatcctgaaagcattaggacaaaagccaaatgaaaagatggagggagcctgggacttccatactagccccgggctgcctaccccagactcctgttgcctaggaagagtatattaatttgcttaagcagctgcttttgtgtgcctgttatatggagccatacaaaattcctaacagatgaaatggatatgatttgttaagaatttactacatgctagccacttttctaaaagttgtatatatattatatatcattgaattctgacagtggccccgtgagatatatcgttctattttaccaaaagctctaagaagaatcaatagcattttaaaatggacttttaataatgccagggtaaatttctgtgtgtaagtttaaattttatttactttaacctgacttaactcctctcctaagatagtctcttgacacttattttacacataatgtattttatggtgattatattctatgcctcttatatggacttgaaattattaatattcatcctccattgggctcaaaaacaggtgaagtttactaccaaaaacaaagaaacaaacaaaacccagttttgattcttgtaacttgggtgtaaactatggagagaatctgggttgagtagacttgacctcattgtagatgctgtaagtatgatatataacatagcttacccatgcatgtcctgaaattaatattatattctagtggtctggacagtttcattatttttgtattgcaattgcccatgttaaaaatctgtctgtgctgtcatgttccttcctttcctcttcagagaaaagtgattagaacattaagtggagcaaactgacctgaccctcagagataaataaaggaataaattagcttgcaaagaaatggttcacactatctagaatttatttgcagcttaaatatgagggtgggaggttagggtcttgggagacaaattgagaatctagctttaaattagatttaatatcagactgaaattctagtcaattatcctcaaaataactgaaaatttctgtggcactcagtgttccacaaaatcattattaaagcccaaccaatggttttcatgagtcccacagcctagtcccctatatggagatcacagagttttcaaatcctgtcttctgagtccacattaggtatatttgaggcataatcagggtcaaatcagagaatcaccaaaatttaaagacctcatagtatctagtttaaggtaataatttagaaatgaaaataatatagctgagaggtagaagtcacccctccacttaatgttctaatcatttttttttctagtacctaagccaaaaatagagttaggggctcctacgtcttaatttctagtcactcatggtctcccatgaaagattcctgccataatcagtttggctgctacaacaaaataccatagactgggtggcttacgcaacagacatttattgctcacagttctaggggcttggaagtccaagatcaaggtgccagctgattcagttcctggaaaggactctcttcctggcttacagttggagatggccatcttcttgctgcatacagaggaagagggagagagctatctcatgtctcttcttataagggcactaatcccatcatgagggctccacccccacaacctaattacctcctgaaggcctccaaatactattacattgagagtcagggctcaaaatatgaattttggggggacaaaatttagccatagcaatttccctagtatttttttcatattctaagtctcactagatgggtataattacaagcaatgagtaactttcaaatgtgtcctgtgtttttgctaaaaccaaatccctatcccaaatgtggtcacatatggtatcatttcccatcaagaaaaatgtagaaaatacccctgttgagatgcaacctcatgttcaaagagcctgctgcccaggtcacaccagaccacacccagagactaatacaacgtggaaaagagtgagcccagagggatgggctaagcttacatccaacccacttcccaacaacctccgtcagcctcaaattcaaggtaacactaacagtgatggtgtaaatcccagttccaaggtcagccagtggctccttagaggcagtagacagaaggcagtagtttaggtgtgcactagtgcagctgagatcacatgccggctccactagtaactcgtttttaaatttgttttgagaaagtcacttattgtctctgtgctttggattttttcatctgtaaaacagatctaacaatattaactccatagagttaaaaggatcaaatgaatgactcatgtaagtgtgatcccagcttgatactagcactgagtctgttagaatcctaaatgcaggcaagaccaaggctcaagacaaccaagaactcatcatccagttcccatcaaagatgaactcttcacatatcttttccttaaccaatgctttttccatggatggatttggtgacttctgaatagtttaatcttgtttcgctctcattcccgtttgttttgaagatctggagagtaggcaatactcagccattttcaccatctgcatgaatattttcttattgatgcacgtgtctataaatcattctgtgtgcctttctccatattctgagaattgcctgtatttgagggtggaggtcattgagtctttggggaatctgatagtagcagttcttattctctctcccaccaacactactaccacatacatatctgaacaattgacatacgatcttagaggcccagcacttcctgatgccttcatggaccctctggaaaagtctgtagtgataaagtcttctattctatgcctacatacgcttcttaaaataaagacggtctccaaaggatagtttttttttttaatttaagctttggctcatatataatttaagaaaaaaatttgtgaaagaacataagtgatttgtgctcaacatctaaagaaaagacacatttctcttcaactatcttttcctttttggtgattttggacttcctgggctatgctgaatgtgataatattctaagctagccaaatctctcttaaggacctgccaattttcaaagcaaagttatgtaattatgtatttccaacagaagaaaaagttaaggtgcatatgaaaacatgctgaaaagtgtggaaatgttatcaaagacaaattatacatttatcacttcaaaatccagacagtatagaactgcagtgcttatttgtttagactgtccgcccgaagtgtaactgttaaagtacattaagcagaggccttatgtctgctttggatgacagctgggacatttttatttcatagactgcataacagaacctggccaacttcaaggtcaaagtcagaaatcatgatctcatttccactattgactcagacttgcccttatttatgacttacagagctcactccatgtgccatatctagtcagtatgcaatgagatctgtgaaatcaaactcatgtcaaacccctggccatcatatgtttttcaggtaggcagttggagtaggggataactggattcttgtttctatttgggcaagtcacaacttctgtgggccccagtttatttttctgtaaagtggccagattgaattacttacctctcaggtcccaggtgatgctcttcctgatcttcctaatgatttatcatcatggctgatgattgattgcctgttgtttcttttcccaaagataataataattgtcaaaagcctgagatgtatcaataccaggcactgatcaaagcacgctatgtttttaaaaaaattctcacaacaaccttatgtcataggtgctctcattctccccccactttgaaatatgaaaaaaacctgcagatcaggaaagttcaataatgtgctcaaggtcatacagttggcaagaggcacagtgaggcttcaaaacgaaggctgtctcgttccagagccagcacaaataatgactctactgttgaagcaaagcaataattgtttctagttaggattcttacatcaacttgcgtattttccagtgtattttcttggatttgagacatttaaccaaaatttacacactttggactggaaccataaaaaaaaattgtgcccctaaaaatcacctgatataattaattcccctgtcaagcatatctgcttttaactaagtccttcccatgtctccatatcagctttctgttacagatacattgattgctggctgcatagggtttcaaaacaaaatataatttgaactggaaagtttcggttgttatttatgtgaccaaactttgaggttgcacttttcattcagcttttaggtgtgctgatagccaagatctttgcaagttcattttttataagaaataggctactagcaaaatacaagtttatttagaaatactgagaatatactgcttccaccaggagaaaggctaagatactaaactgaattaaaatacacgtaaacaatgacatgatacataagaaaagttctagaaaaaaaactttaattttaaataagaattacttatataccaatcaggtactcttcattcatcttttcagcttggcatattataaactaggggccatcatcccagaattttatagtaaatatacttttaagatgtctcactatagagctttcaagaggggttactaacgaaaacaaaacatactaaaagtagactgtttcaatgttttctggataatgggataaagtaaaaacagcatttggatgaggggtcaggagtatgatgtctctctttggaaggacccaagaactgcagaaacggcacactaagcaaggggcacaggtgatcccctggggttagacaaacacgggaaccactgccctgctccacagcactctctcctttagactctaagctcttcagcggggtcatggacctctaatgcagtggaatacacaacagtttagtcaacttcatacctgcactgttaacttgccaaactatttccttgaggctcacttatctcacctgtaaaatgaggagatgggactggatggttctcgaaggtcatatctatgtccagcattcccatcttcagtctaaaattatgtgaggaattaaactctgaaaggtgtctttgtcgtgtatcattctaattcatgcctcttattgaaggacttctggttggttggttgttttttccagctgtattgagatataattgacaaataaaagttgtatatattcaaggtatacatgataatgtgatatacataagccttatgaaatgattattcagcaataaaaaggaagaaaattctgccatttgtgacaacctagataacctttgtttttaccattagctctcttttaagtcagtgggtactctgagaaaacataacctacttagtttcgaataatgctctgtgggtcttctatcctgcatcagccacatttatatgctaggagaagaataaactatatataatggttgtcatttgttaaagtctaccccatttcagttattcagttgttcttgtctttacttttctctctaaggatattccaaaaatatatgttagtatttaattctggtaaacagatcagattcttggagttgggttttgttggggtgaggggaattggcagggcagagaggattactaaaataaaatacacactttcaaaagtgtttattgtgttctaggcattaggcaaggtgctctgcatgaagaaacctatttagtgagtagactagccttggaaaaacccacaacccttaaaacatgttctatgggttccctctgtcctgcccctgcatcattcagcaccacagattctttgagtaatttcagatattacagtaatttcactttaaggtattaaaaagtccaacctgatccaaaacaaaattttcatcagagacccaattcaaagtttcttccccatcaagcctggtccaatttggaaactgtagggggaaagtggggagcggtttctttcttcttctcaacgaactagttatacacacacacacacacacacacacacacacacacacacacatacaattttcaatcctcatttatgacaatctcttaaagtaggcttgactgttcccattttatagaaactacaactaaaaagacatcatacattttatagggtttgacccaaggattttaaagcagattgtttccactgccctcttttacctctcaaaatgtcagttacccacatggttgacgtgtgtggtgtgaatgtggtggttggatttgcttctcttaaattacgtttcccaatgaaaaaggatcaaatagtttagttatgttgaaatactttttgtgtatctgcatgtgtttgatgaggcacaaggctgtttcaccctgaacatgcctctcataactcagaggtatccaggattgatgcagaggatggctgtgactcctgcggtaaaatgtagatactttgtccagcaccagcacatgcacataagaaacatagagaaatatatgtcatatatagaaatcattttgtagatgacataaatcaatcaataattgttaaagtacatttagtggattaggaagcagcacaatgatagtacaggcaagttgcagaatagataagagtaagtttgggaggatacaaggtgttggcatttttcagaataaaatccgactcataaatatttgaaggactctagaaagggaatatagaaatggtatattgagatcagaattgaaagtgaggtaatttcatgtgtgtgatgtttattatttagtgagagcaatgagtatttgaatgttctatgtgaatcatccctgtgagtattacacaaagatttagacttcgaggcatcatttctctcactcttcaggaactagatttagagcttgagtcattgctttatatttttgaagtatatattaatatgttttttagtaaatccagtgattcctgggtttttaattgaaagctaagtattatggtgggatataaaccaaccaatttctaatggatgccacttggaaagtttttctttctcctacagaagagaaagcagtgggaaatggcatataatgccaagaaatcatgtttcctgcttaatccatgtgaaaagtatatggatgactgtcaaaaagatctgttcaactacaaatggagtacagatgaccatgtggtcaatacaatacaataatgcaatatttaatactgtaatacagtttccaatagtatgaagttgaaataggtgttgagatgctttaaattgaataatacagtgtattttaagtgcatagaggtctttcttacaaagaaagtgcacggaaaactttagaaggtaaagacacaaagtataagatgtatcttgtgttggtctttagaaatttgaattctctttcaagctaggacaagtcttgagatgaaacatacataaaaaaaaaaaaggtctttataaacctgaagtctaactcaatcctgagtcacatgatagacaaccaaaagcaccatgactttatgcacctccatttgtttccctgaagctcagaggatccctctgaatgcattcctcagacctcgtggtgaatccagcaccttgaggatcatattgaagtttttaaactgagcctaaaaactccattactacagcttaggcttttcttttcctaagtacttttctcatgctccccgcaggcaagatttgctgcaagcacaaacctgtctcaggctcaatatctacctttctgaaaaacattttttatgaaaatggctttgtgtccatctcgtatcctgttattttcagctcattgagacatggcattgaatatatctcttacatggcgttgcatatatctctaaaaagagaaacattttttctccacacctaattttcttcacctctatcaattcttccttggctatacctttacttaactcctatgtctgcaaggcttttgaagttcctttgcaaagatccattttaaactttctgtatattgtaatttaagttttctgtttctttctcccatctgctagtcaaattttcttctcagcagaaaacctcaccattgcttcatttccacacatggaaggcattcaagcatagcaactgggagtcacagttgtactgaaatgagaaggaaatgtgcttcccaacacagcgtcagcatctccaaccagaggccatttgtcttttttttttttttttttttttggcttttcagcaaatgactgctaaaggaaagtctctcaaaacccaaatcagtagcactccaacccttgttgcacaaagcattacattggatcatggaagggttaagatttctattaaaaatgtttctcatggtgaatctgagatgaatgtatcttctaagcttgctatgattcttccccagccttctcatttcctactcattgactcctctgttggcgtcagctttcccctctggtctcctgggtgggttcctttccattctgctcaagtctagctctttcagcaggccccagctggcccaccaaattccttgtgcagccttaccctgtggcactgtggaagggcagggctttcctggcacagcttggctctttgctgccccaggaagcttcctcccatcagccttttgcccttagactcatttcgaagaaaaagtccctgtatttccccaaatcccagaggacataagtcacgctttctgaggggttctctgaagcctcccttattcaaactctgtcaaggaccaaggaaattctgtaacattcagacaaccttctctctaaactctaaagaacctatagctgggtcgagcggcgtggctcacacctgtaatcccagaactttgggaggccgagggagtggatcacttgaggtcaggagttcgagaccagcctggccaacttggtgaaaccctgtctctactaaaaatgcaaaaattagccaggtgtggtggcaggcgcttgtaatcccagctatttgggaggctgaggcaggagaatcgcttgaacctgggaggcagaggttgcagtgagcccagatcatgccattgtgctccaatgtgggcaacagagcaagactctgttgccaaaaaaaataataaaaaagaacctattgccaccccaaattctcaacacatgctagactggactggcaagggttgagaattcagactggaggtgcggggtggtaggggaggtgggttggtcttggcagagttcagttttgatcacccccttagcatgtcctgcattgatgacctggcagcttcattagcatgtgaggatatttgacacctgttttcctcagctttgggacctcagctgaaatttcaaaacaggaagtttcattttgtttgttttgttttacattgttttgttttgttttcctttgtcatgcagactttttttaaaaaaagttttaggtactcaaaattatcaatgtattttctggcttctagattttatgtttgcttagaatggcctttcccactctattttagtttactggggttattgttaaaaagtaccatgaactgggtgacttaaacaacagaaatttattgcctcactcttctagaggccagaatctgaaattatggggttatcaggagcgtgctccctcttaagcctctagggaaggatctcttccaggcctgcctcctcgcttctgttattctgtggcttgaggcagcataactccagtcttcacgtggtgttctcccaatgtgcatgtctgtgtctaaatttcctttttttataaagacactagtcatattggattaaggacccatcctacttagatataacatcattctaacttaacaaattatattcataacgacctcacttcaaaatagggttatattctgaggcactggcaactaggatttgagcatataaatttcggggagtgggcacaagacaatctatacacactctactaaacacactgtcctggctttcttataagtcttttggatagctagctaactagatagataatttttgttgttttagtttgtttattttcctcatctgaagttcacctgaaatttacttggtctaaggaataagacagggggaagaatgcacatggatattttactgaatagttagtgctaattatagtgttttatccattatattattctctccagagcctagcaaaatgattgatacccaataaataaatataaaaatattgacaccaatgctcaataaatttctttaagattgaatcacatcacttaccaggtaactgaattgttaagtttataactagaagatagcttgtttatttgaactgatagcggctatctagaaatttgatcacaggtagtgaagatatcctagagaattgacaaagcctatagctgcagtgatctgaaaggatattgggttaaaaaaatactaacattttctgtttattgaaggaaatgaatacagttcctgtgacatatcttttgtaccagcacagaggacagggtaatgacctagaatcaaagaatgatttataaaacagagctcttcttttactggcaggtagtagctagattattttgtgtgtgtgtgtgtgtgtgtgtgtgcatgcgtgtgtgtgtgtgttcaaggtacatatgttggggaagtgggcaaggaaaataatcctaggaacagccatggaagctcatgaaaatatttagaagcaacattttagagcaataatagtaaatgattgtttggggtctattccaaattttaagttttagggaacaatctccttctttatgatgctaaattcctaagtatttttcatataagacaaaaaagatataaaaaatattgaaaactaagttttggtggctaggaatgaaacttatgtaggtccatgttcggtatttgataacacatagatatgtacttggatattatgctacaaatagctgaaatttttacatttaatttatatttatgttcagagtgattacagatagtaatttgtattttgatgggaacacatggagtctgcctgaccattggttagtgtcaagtgaagctatttcatgggacaagatggcaagataagtcactgacatcaggaaagtcattagaaaaaaatatatcaagagtttatctctcagcaaaacactatatattgtttatattttaacatagtcttccctgcatgtttcagagaaaagtattaatatgctagcttttagaaacaaacagtttttgaattactaataaatattttttccaactctgcctaagacatttattttaaactgaataaaaatttaaattcacccattctctattttctctacattttaacaataacccaactgcaagtcactccaattcccatataattgtaacttctttttgaaaagcttagaattatatgaatcatgctaagctcttttattattgactaaaagggcatattctaatcttttactatctttgctggatgtagggtataaatagaaaaaccctatttcaccagggaaaggctattacgtgtccaaaaagactttttgtttttccagcttagggaacattcacattttagatgctggctaatatatgtttcctgagctgatggactgtaagctggttgtatttggcccctgtcatcttcttccaccccaatgatgcaagccagaacagagacacagtgtcaagtcctatgaacaagaacacgatgtggtagtgtaaagcaaagagacagtgtggagtggaggaaaggaggaaacagtgaggaaaattttgaaggagaagcagcagggtgggggtatcaggaaggagagagattgagggttctgtgaatgtcatggtccaggacttgggacttggctcatttttttttggtagttctcagtagattccttgatctctatgagactcattgcacaatttgaactacatcttctctagagcccctttcatctctaggatgctaggcttctcttaagcttaattgtgaatactctgaaaggagaatctttgctttcactgaagacataatatttggagcgcttcaatctcaatttttttgaggtagacaattctgttatagtacaagcctgtgtctttatctagaacatggtaattctgtagatcaagggccttcaccttatggtttttccacatggaatgatacatttcagttctttatagtctcatagcatgctgtttatctgaccaaaggcagttttgttgttgttgttgtttaacatattttctgtagctttctccctgaaaatgatgtcttcatatatctttgctgtatttgaatgcttttaacctcaaattaagctagttaatacggttatttgattcaaaaatctgaatcagaatcagagaatccaaatgtgaattattcagcaaaatcatgcaggcttttctttgcacggtaaaataagcagaggcaatattttcttcagaatcagtgagcagtacacatatcctttaggcaatgtactgtttgattttcagtgcggaaatgtgtgctatgctctttcttttagaggttcagtttgtcagcagatttttgtgtcattctaatttttgcttgtttctttgggaatctaaaatttctccatctgtatattttaaatgattgggggccaaaatttataaactgaaataaacagggaaattaaccttgttaatgaatggtagtaagggaaatgtggcactaatttacaacaaataaaagaatcaaagaaagggaaggagttcatttttgagtgaggattcagaagtttcccttttaaaaaaaatgagataacccataaacaataccaacactttagctacttgttaattaggccattgaactttcctttgagatcctagaatctgaaaaaataattagctttgcaaggccattagtgaaggagaaaaacttatattgcctagaaaccagatcaagaatgatacagaaagctacacttcttgcatgtggcattattgaagtgaattgtaagaataaaatgacctggacacttgtatgttatatgaaacaaaaacaaaaaattgctcagcaacttattaggaaaaacatttagttatcctctgtattcattccctactagtataacaaatcaccacaaacttatggcataaaatacacaaatatattatcttatagttctgaagttagaagtccaaaatcagtcccactggaccaaagtcagggtgttggcagggcttctttccggctggaggatctagaagtggacaggtttccttgtgtttacccagcttgtagagattttctgcattcctaagctcatggccacttccttcctccatcagcacatctctttctcttctgaccttccggtatccttcttataaggatttgtgattactgtgggcccattcagataatccaagatactctcctcatctcaagacccttaatcacatcttctaaagacctcttgccctgtaagttaacacattcacagattcaggggatttggatttggacttcactaaagggctattattcagcccaccacatcccccttgcttcactcagctgtttaaacagcaagtacataaatcttaatggaataagggctaatttttaaatttatttaataaaattttttttaatttttgtgggaaaatgggtccatcaatagagaactgattatgttcatgaagaaaatatatgctgtttatgcaaatattgtttatatcaaggcttgtttctaatccttaaaacagattaaaagtatcagaaaagacatgaccaaagaaggaaatagtgaggcactgcttcccatgtttattttatttcattaaaaaatttaatcgacaaataaaagctgcatctattcaaggtgcaaaacatgataaatcaaggacttccacaatcattacagatgaatattgggatattgccaatgtgaagatctgccttatccttgaaaagaaggaaatgaaactggtactaaactagaatgtcattttggaaaattggacaggcaattacgccagaggaaaatttgtattgtgatgaagtactttttgttcccatgagagaaattaacatttaaatggctactattaagcaatctcacaaaaattaagatgaagtgtcatagaacacctgagtgaatactttttacttttgctgttctgttacctgcaggaataagtttatagttgtaagaacaaatctttagtatgaactgccttgagccacagtgaagagagaggaatcatttgtatttgggaatagtggctggagttgaggatacatacaagaaaaagctagagatggaacctgaagccatagcatgggacctataaatactagactagaaaagaattcttagttgaataggaaatggtagggtggtgactggggattttaagcaagattgggatattttaggaagattcatctgaccattcttttagaggcaggttgattaggaaaataagttaatgaaaaagtgagcaaattgtagctgagataatgctggaagaagggaaggaacagatttgaggctgtgcaaaggaaacacctttgtgatttatcagctgatttgctgtgggtcgaaggggtgaatcaaagaggaaaacaaggtttccaaagttcaagcttttgtaactgatgttggcattatcaagaagtgatatgtcatgaggagaaacatttgtatggttgaggtgaggcacgtgaagtttcagtttggaagtattgagtgtggggtgactacagacatgacaatggtgatgtcaagtgagctagacagaaagctcaggaagacaggtcaaggctagaaagaaaatatgagtcaactaacttagaggttatatgcttatgtgactgaacatgagagtggcagtaaggtcgactcttattcattttatcgtcaaatagcttttttgtacgtaggtcattttgccactgccactatgttaaaatagaatgaaaaagacattcttgaggcattattacttaaagacagtttttggctgggcgtggtggctcacacctgtaatctcagcactttgggaggctgaggcaggtggatcatggggtcaggagatcgagaccaccctggctaacatggtgaaaccctgtctctattaaaaatacaaaaaattagccgggcgtggtggcgggcgcctatagtcccagctactggagaggctgaggcgggagaatggcgtgaacccgggaggtggagcttgcagtgagccgggatcgtgccactgcactccagcctgggcaacagagtgagactccgtctcaaaaagaaaaaagaaaaaaaaaaaaaaagacagtttttaagatgatttcagaaatactgtatggtatataactattatgagggaagtgtaagagaaggaatttaaatgactgagagcatctgaaattattccaggatcacccttccatgaatccatatattttctcaagatttggggatttactcaacatgttcctgacagtttgcaagtttgcaaaattataacacaaaagactgtattatcaactagtactttccttagctctatagtgttctgtacatcattaaacatgcaacaaacgatgtttccttgcctgaagtgtatattttttctctttgcttttactgaattatcttttttgtaccttcagcctactttgagaaatgaggatttactggaggaatttctctctgttctcagggctaggaatatgtgattctcatgaacatggtttattattttatgacccaaatattgaatattatatagctttacaccatgtatatctctttgcattagctacagaaaagcctagagacaaatttatgcccacttttataagttttaaagcttgaaaatatgtgatttagataataatttaaatttgaattcctggcttcattcttcttatatacttttcctcctggtctgcaattcttttttgttatttttctgtttaaaaataaagttatctttttcatatactttgtaaaccacttagaattgtacatggaaccagttatgtacacgtctgcattttggttatatctgcatacaggcacatgaacactgggaatacaggaatgatgtattggtttcctattgcggctataaccgggtaccacaagcttaatggcttaaaaaaacacaaatgtatagttgttcccccttatccatggttgcactttctatagtttcagttacctgtggtccaccatggttaaaaaagtgtaaatggaaaattccagaaataaacaattcatacatttaaaattgcatcccattctgagtagtgtgatggaatctcacactgttccactccatcctgtctaggacatgagtcatccctttgtccatactatccacactgcatacactaccctcctgttagtaatatagtggctactgtggttatcagatcaactgtcccaatatcgcagtgcttgcatttgagtaactcttacttaacttaataatctaatggtaccaaagcacaagagtattgatgctgacatatttttataattgttctattttattattattgttcatctcttactacgctcaacttataaattaaaatttatcatcaatatgtacaggaaaaatatagtacagccagccctccatatttgtgcattccacatccatgactccaaccaaccatgaactgaaaatatccagaaaaacatgcatctgcactgaacatgtacagactttttaccgttatcattattctctaaacaataccgtataacaactatttacatagcatttacattgtattaggtattataagtaatctagagataatttaaagtatccaggaggatctgcgtaagttatatgcgaatactatgccattttataccagggacttgagcctgtacagatttcagtgtctgtacatcattaaacatgcaactctgtttcttcaggttttggaatcaacttaattttggaacaggacctgggattgacagaagcagtctttatcacttcttttgaggcagcctagagatccacaggcctcagttggaatgccaacttaggttatggggtgccacagttagtaggctatcaggccaagtaagtgagcagctctaggaagtgtatagtgtctttttttctggctgtggcttagctgaacattcttacctgacccccatatccacactggttcataggaaaaaggtaaaggatcttcttaatggaggccattttcaggcctgtttgaatttagcagctcatataggaggggagtattaattaatgaaagggcaatgtctgcaggaatagcactgccaaataaaaccgttatctggctttctgggggatcagaagtcatcatagcaagatatcattgttcaaattggtgaccaggagttgcaatcctacttttgcccttggctggctgcatgcattagggaagattttaccgccatgtgggctcctgggtcaaaaaagacagtgatgctatccacttgttttagaggcccagttctgcccactgggaaacatttgttacagattatcacaatgtgttactggtaatatattactgaatatattgcaatatgttactgataatatgttactgaagatattggtgtggcagtttttacttaaaaagagaaatccttaagcttatgtttaataagaaaatgtgatagaatctttattgaccctaactttcatgagacacatacagatacatgctaatccctcatagataccaaaggatgactgtctatatagggttttgtactatccatggtttcaggcatccactggggagtcttggaacatatttccctcagataagggacaactactgtattatcttatgttcttggggttagatgtctaaaatgaatctattaggctgcattcgttctggaggttccaggaagaatctcctgtcttgtgctttccagtgtccagaaactgcctgcatcctttggttcatggcctcttcctccatcttcaaacccagaatcttctctctttaactttctgtcgcccacttaaaaagacttatgtgattacattgagcccactcagaaaatccagaataactctccatctcaagatccttaactaaattatatctgcaaatttccttctcccaaataagaccacatattcataggttccaggaaataggatgtatacatccttggggtatttttcagcctgcaacagataataacttcttctctgagagaactggctcaagctgacattagttaagctaatacagttgatcattcattcatttagttggcatacttaccagactgttattgagtatctactatgagctaggcattcttctaggagctcagaaaatgggaataccatagtgaatacattcactaagttccgtgttctctaagggcttagattctatgtataaataaaaacccaggcacatggaaaaaacgtagatatagaaagtgttcacctttcagagatggacgcatagttcaatatggcagtagcatagaatacaaagaaatgaagttattgtgagctatgctagaaaggttatacttaatctgcaggaaataattttaaaagaaaagcaggtgacatgattagatatgtaatttatgaagatgcctgtgggtgaaatgtgaattagagggaaacaagactggaattagaaagaccaattaggagatgctgctttaatccaggtgataagtgatgacagtctgaattaggttaatagcactggatgctattggaggcaggaagtaccataattcaaggcagcacaaagaagttgaaaaatatcatcatgacatttgtagagtgacctatggagacaaagttgataggaaagagtgaaagacaaaagggatcaaagacaaatacccaaacaacacatagattggctcagcatttagatacactagtatcctttctagtcactactgtattatttcgtattcttcagtttatgaagctttagacttaggccattgaaaatttatgagctaagtccctgaatagacttgctaaagttttatttggtttattatctcactttattccagatttccttctctaggaatagattagcaatagttacttctaaatgtctcccattttaggtataattaataaaaatattaacaactggttttgctatgactgattatggcttgtgagtcctgttgctgtctgtactgccctttgttctatagctgtctctaattctgattctctttctatgtgtctctctctcacacacaaacacacacacatacacacacacacatacacacacacacacacacgcatgcagttaattcttagagccagctctcttaatcaaatggaagtaaaagggaggacagactcttatcaataactttaattttgaaataaatttataggtaacagggtatcctcttggcccatccagttgtccagcccattgaccactaacacagtcccttggaggagggtagaagcctttgcctatttaacaacatctctccagcaacgttaccaactttgatacaagcccagttaccctccaaatagagttgaaaaaaagaaaaactttccattttaaaacctcaaagtcatttcactcggtgacctagagctcaaggactttttcctttgctaagaactccaaccacccagctccccagtgaataatgaagacaatgtaatcatctttgtttcttttagtggttaattgggagcaggatcattttatccatcttcgtgagttgaagcccttctagaaatgattgtggtttgttttgcccacccacaagataccaaaataacctgctatcttcgcaaaatgtgcatctattccccaaatcatattttatgccaagttttaaaagagagggaaccatgccagaattcattttaaaccaagttttatttgctatttctagtgctagtgcatggtagacagctggaggatagttccatttaagttgatttcttccttgacactgtttcttttcagatatgaattagatagaatagggctaaaaatgaaggtaactaattgtggactaaaaacaacaacaacagaagtaattgcaagtaaagaaaacccagtaaacgtttcagtaataatttgcttggtgggggagtggacatttttttgcttgtgcttaggaactattaattatatgaatgttagcaaatcacacctaataaattttggcctatatgaatgtggcatcaattgagatacaaggcaaaaaataagaagacccaatccacctagagaggaggtagcttaatattggcataaattgcatttaatataatgagcctaatctaaacattagtgcagttcatcctacatgtaagatgcactcaagatatactaaagaaataatatgactcagcatttagatacactagtatcctttctagtcactactgtattattttgtattcttcagtttatgaaaccttggacttagaccatcaaaaatttgtgagctgagtccctgaatgtacttgctaaaattttatttggtttattcaacatttccttctctatcaacctccattaaccatcttagacactagatgaatatgatatttccaacatatgaactattttaattaattctggtaaatgctttagagaggccaaaatgtttgtttctatataataccaaaaatcattttacttggtgccaagaggtatggatgtttaataacctgtttattgttctaatggtttctccagagcacccataaagaaggaatctcgtaaagatgttgttgactgttgacttttccccactcacttcttttccatcttctacataggagatgctcctcatagctcaagcctggctggctgaaggtttttgacccaagagcatgttgtttatggcagccatgtgtaccatggcataaccttacctctccctgtcttactgtttaatataagtagtagcatttccaggacccagaataggtcaaagacaactctaaattgcatacttaaatttttgacaatgagttgacctccatcagatctgtagacaatcttctcttctgattctattcagggcatagtctatcccactttttgaaagccaactgttttatgccactaaattatgaagcctttacataaagtaacaatctgctcaaaaggtttagctcctcaactctcctaagaacatgtcaattctactgtcttctcaggccataggttctacagaaagaccaggaaagatttgtgttctttatcactttgcaatccattttaattactttgtgtgacttattgatatttctttggcctttgaatctgtgaataggagttgattacagattaaactccataaagatattgcgtatcttagattattaatactgacaccttaatactacttagaaaatcagtagaaatggtctcttgatggatccaatcgtgatttctgtgaagtcaaacatgtatttgatttgtttttgccttttttgtaatttttaccttaataatttgttaacacttggtagtgagttggatatacatcctccataatagggactagaaatagctgacatttgttgaccttttactctgtgccaggtattaggctaagcatctccaagtttattctcatttaatccccacagaagctctatgaagttgatgccatttttatttccatttttccaaatagaaagctgaagcctagagagatagaagtaacttttcacaggtagcatggctactatgagacgagaccagaattcgagtcagaaaatctgactccagaacctgaactcttaattattactatatactacctcttatgcgaagataatattgttttcttaatttagatttggtatggacaacttatcctgctccctggtgccaacacaatatttcacaacagacaataaaactaaaggtaattttcacaatgaattcctaacttttaactggcttaagtatgagatcctacagcaatttaaatatttcagttatgtagatgtctattttgtaaccagataatttagagggcatcccatgaagtaattctgctcaagataattttatttttatttttattttatttactgtagatgttttgttgaagaaaaaaaagtgtatggcccaggttaatttctggttgtgaccgttccaaaatttggattgtgggggtggttaaaatcagtgttgccatgcctgatggtgaagacaatgaggcttgactatccatttgtctagtgggagagcagatccaaaattatttcttaaagagaatcatggcctttcctccttccattcattcccttgacacaagttaagtggggtggaaatgtcctctgttcaggccgttattcctgacagcctcctcaacttctcctcaaagccctgagaggatgcaactcttctccttgttcagatgactattaaagtacactgcttagtgttaagtggtataatagacaaactgtactccagatcaaattcttgtctaatattctgtcactcaatatttagcaaaagcccaatgtgtgaagcaatacttaggggagatatctcgaagtttatatggctcactaattcctctaaactactttacaatttatacctagagttatgcatactggcatccatccaaactgcctcctcctataagaattactttttaaaatgtatacccttctctagaggcagaaataaggttattgagaagcaacaggaaaagctatatagacctgaatgacccagttcttggcattagaaataggtacttctagttaagaattctatagccatttgagatggtcttaatgttttctaattttaaaatattatttttaaaactgaaacaatggtaactgaattcattcctgtttcagttatttattagtgtgtaacaaactataccaaaactaagttttaggcttaaaatattttattacttctcatggtttcctatgtaaaaaaactggacaggacatggtgtggagaattcatctctctccacatgatgtctgctggagtgaaatgtgcaaaatggcttctgtactcacatgtctgatatctcaactggggtggcttagacagctagtgttggctgcaataacctaactggggttgtatgtttggggccacagatttctgtcagctggattctttaattttcctccatgcagtctctaggtctttctgtctctctgtatcttttcacatagtctctccaacagggcaatccagcttcttacgcagcagcttaggcctctggaaagtaaaaaacttgaaactgtcaggtctactttctgcttaggctgagaaatggcacaaggttctttgctgcctttgtagttaaagaaaaaaaaagcagactatagaaaggcatgaaagatgaaagcaggatgtatagttaggtggagatcattaatatttcttattactatagttctattagtttataatatggtgatataactaataagatttgtaataactaataaatccagttaccacatttaaaaagtatagcaattgatcataagataagaggctatcattgatgatagcttacagaagattttcatgtttcgtgataagttgctcttaagccacttttgtatgtgcttattactaagaactgtatatttaagtcaccaaaaacacatacattatgatagttcacacaatttccagtaaaaaaaaaaaatggataaattgctttatttctttcaagccactagttcatttttagaatgaggtccacagtgcacctacatcagaatttcccatagggctactaaaagtacagattcccacacccactcttgtcttactgaatctagtctttaggctgtgggggaatgtataatgaagtttcttctgcatttgttcataagtgggctgagttttctttctccaaatggagaagagattaacaaccggagagtgttggagacgtatagatggggtgtcttctggataaatattggtttaattaacaggaaatgaaaagccaaggaaagaagcaagaaagggaagaagagatgtttctttcttagcattgacacagacgtaaggagaaaccagccaaaacacttttacatctttaaatccactaattaaaagatctgtgtggaaggagaaaatgtgggtaattaccaggcataatagactctctgagagacactgactgggactgagacggaacagtcttggtacaaaatgtcttttcagggaatatacataataatgtcatattactgaaagcttctggtactgtgcctgtacctagaacccagacatgcaatgaatacaagtgggtgtttgatctcaaaatgtatatttttttgcataatgcacttttggactagagtttatctattttctgctcacctgtgatgtcactgaaaaaacacaccagataaatcacatttataccatgattcgattagtgtgtggaactggtcttcttgttctttaatcataagtgaatcttccattcttcccttcacaaaatgtgattgtgttctgaagattcatggacccaagcatattttagaccaggggatcacagtctagacttcagctaaagcaataaagtgacgctttttcttcaaggtcagaacacccaaggatgagtaagcctgctgtacaatggttcttttctgatacatctggcatgaaaatagctccaaatggttggacacttaaaatctgaaagtatgtatagtcacagcaatgaaagaataaggttgtatatgcaatttaaatagatcttaaaatatagccacgtccatttttatctcagtgttttataaactcaaagtttagctaatggaatattcactgtttgttcaaacgtttcgataatgcatttgtttaaaaaacacaatgaattagtatactattagtcagaaatgcaaatacatatttgctaggaagaaaataatgttcagaaaaaaaagaatagactgacctcatatttataattgaataggaaggataggtaatgatatcttttgccagtagctgggattttattttgatgttaagcataaagtttagcctactaccaccaagataacattaaatttaagtgggaaaaacattatgacagttagaacgttacatattctcttgagttttggcccatatgcatcatttttactgtaaacattgaggtgataatagcacttcattcaaatagaagtaagcatcaatatccaccacccccacccccagatagttccctatccatgccctgtgtttgaggattcttcttgggccaacttttctggcattgcttttccatttctattcctttttcaattactgtctccaaaataaagtatttagacaatggttgtaagtccttggcacctataattttataatcctttagagattcaaaatataatttcttggctgggcacggtggctcacacctgtaatcccagcactttgggaggccgaggtgggtggatcacctgaggttgggagtttgagaccagcctgaccaacatggagaaaccccttctctactaaaaatacaaaattagccaggagtgttggtgcatgcctgtaatcccagctactcaggaggctgaggcaggagaatcgcttgaacccaggaggcagaggttgcagtgagcctagatcgtgctattgcactccagcctgggcaacaagagtgaaactccgtctcaaaatatgtatataaatataaaaatatatataaattatatttgtataattatataaattatataaatataattaagataagtttataattatataaatttaattatataaatatagttaagataaagttataattatataaatttaattatataaatataattaagataaagttataattatataaatttaattatataaataaaattaagaaattatatatatatgtgtatatatatatatatatatatatataaaatttcttaaaaccttgcaattcacctggactgggaatttgaattataatataacctgggaataaacatttttggtttcaaactatgagaggtaggtcataatatatcttgtttaatacaaaccatcaggtttccttctttttacccaaatgtaacaaaacactgcaatattttgtttactgttctttgattaaaatagatattaattcagccaagaggtagagctgagaaattgaaaagtgactccaagtgacttctattcagcaaaagctaccatagatggtccaacataaatcgccccacacattcctctattaaactctaagcccttgagtacagtaccttttcatatacatatgtctctgtaaacccactgcctaacccagtgaccagaacatgcagggctcaataaatgtttgcctgatggcatgccaattctagtctatgcagggagagcccctctgaatgaaaagccagagtcacaggcatctgggggctttcctggatatgcttgacaacccagtccatccaactatcccatacgttcccatctgttcaatttttttttaatttatattttttattatactttaagttctagggtacatgtgcacaacatgcaggtttgatacgtaggtatacatgtgccatggtggtttgcagcacccattaactcattattgacattaggtatttctcctaatgctatcgctcccccagcccctccacccccacaacaggccctggtgtgtgatgttccctgccctgtgtccaagtgatctcattgttcaattcccacctatgaatgagaacatgcagtctttggtttcctgtccttgtgatagtttgctgagaatgatggtttccagtttcatccatgtccctgcaaaggacatgaactcatcctttttacggctgcatagtattccatggtgtatatgtgccacattttcttaatctagtctatcattgatggacatttgggttggtttcaagtctttgctattgtgaatagtgccgcaataaacatacatgtgcatgtgtctttatagtagcatgatttataatcctttgggtatatacccagtaatgggattgctgggtcaaatggtaattctagttctagatccttgaggaatcaccacactgtcttccacgatggttgaactaatttacactcccagcaacagtgcaaaagtgttcctatttctccacatcctctccagcatctgttgtttcctgactttttagtgattgccattctaactggcgtgagatgctatctcattgtggttttgatttgcatttttctgatgaccagtgatgatgagcattttttcatgtgtctgttggctgcatagatgtcttcttttgagaagtgtctgttcatatcctttgcccactttttgatggggctgtttgtttttttcttgtaaatttgagttctttgtagattctggatattagccctttgtcagatgggtagattgcaaaaattttctcccattctgtaggttgcctgttcactctgatggtagtttcttttgccgtgcagaggctctttagtttaattagatcccatttgtctgttttggcttttgtcgccgttgctttcggtgttttagtcatgaagtctttgcccatgtttatgtcctgaatggtattgcctaggttttcttctggggtttttatggttttaggtctaacatttaagtctttaatccatcttgaactaatttttatatgaggtgtagggaagggatccagcttcagctttctacatatggctagccagttttcccagcaccatttattcaatagggaatccatttcttgtttttgtcagatttgtcaaagatcagatggttgtagatgtgtggtgttatttctgaggcctctgttctgttccattgggctatatctctgttttggtaccataccatgctgttttggtcactgtagctttgtagtataatttgaagtcaggtagcgtgatgcctccagctttgttctttttgcttaggattgttttggcaatgcaggctctttgttggttccatatgaactttaaagtaggtttttccaattctgtgaagaaagtcattggtagcttgatggggatggcattgagtctataaattactttgggcaatatggccattttcacaatactgattctttctatccatgagcacagaatattcttccatttgtttgtgtcctcttttatttcgttgagcagtggtttgtaattctccttgaagaggtccttcacatcccttgtaagttggattcctaggtattttattctctttgtagcaattgtgaatgggaattcattcatgatttggctctctgtttgtctgttattggtgtataggaatgcttgtgttttttgcacattgattttgtatcctgagactttgctgaagttgcttatcagcttaaggagatttgggctgagacgatggggttttctaaatatataatcatgtcatctgcaaaaagggacaattttacttcctcatttcctaattgaataccctttatttggttctcttgcctgattgccctggccagaatttccaacactatgttgaataggagtggtgagagagggcatccttgtcttgtgctggttttcaaagagaatgcttccagtttttgtccattcagtatgatattggctgtggatttgtcataaataactcatattattttgagatacgttccatcaatacttagtttattaagaatttttagcaggaagagctgttgaattttgttgaaggcctcttctgcatctattgagatactcatgtggtttttatctttggttctgtttatgtgatgaattacgtttattgattagcatatgttgaaccagccttgcattccagggatgaagccaacttgatcgtggtggataagctttttgatgtgctgctggattcggtttgccagtattttattgaggatttttccatcgatatttatcagggatattggtctaaaattctctttttttgttgtatctctgccagaccttggtatcaggatgatgttggtctcataaaatgagttagggaggattccctctttttctattgattggaagtttcagaaggaatagtaccagctcttctttgtacctctggtagaattcagctgtgaatccgtctggtcctggactctttttgtttggtaggctattaattattgcttcaatttcagagcctgttattggtctattcagagattaaacttcttcctggtttaatcttgggagtgtgtatgtgttcaggaatttatccatttcttctagattttctagtttatttgtgtagagatgtttatagtattctctgatggtagtttgtatttctatgggattgctggtgatatcccctttatcattttttattgcatctatttgattcttctctctttccttctttattagtctttctagcagtctaccaattttgttgatcttttcaaaaaaccagctcctggattcattgattttttgaagggtttttttgtgtctctatctctttcagttctgctctgatcttatttatttcttgccttctgctagcttttgaatgtgtttgctcttacttctctagttcttttaattgtgatgttagggtgtcgattttacatctttcctgctgtctcttgtgggcatttagtgctataaatttccctctacacactgctttaaacgtgtcccagaggttctggtacgttgtgtctttgttctcattggtttcaaagaacatctttatttctaccttcatttcgttatttacccagtagtcattcaggagcaggttgttccgtttccatgtagttgtgcagttttgagtgagtttcttaatcctgagttttagtttgattgcactgttgtgtgagagacagtttgttgtgatttccagtcttttacaattgctgaggagtgctttacttccaattatgtggtcaattttagaataagtgtgatgtggtgctgagaagaatgtatattctgttgatttggggtggagagttttgtagatgtctattaggtctgctcgttgcagagctgagttcaggtcctggatatccttgttaagcttctgtctcgttgatctgcctaatattggcagtagggtgttaaagtctcccattattattgtgtgggagtctaagtttctttgtacatctctaaggacttgctttatgaatctgggtgctcctgtattgggtgcatatatatttaggatagttagctcttcttgttgaattgatccctttaccattatgtaacggtcttctttgtctcttctgatgtttgttggtttaaagtctgttttatccgagactaggattgcaacccctgcttttttttgttttctatttgcttggtagatcttcctctatccctttattttgagcctatgtgcgtctttgcacatgagatgggtcttccgaataagcacactgatgggtcttgactctatacaatttgccagtctatgtcttttaattggggcatttagcccatttacatttaaggttaatattgttatatgtgaatttgatcgtgtcattatgatgttagctggttattttgtccgttaattgatgcagtttcttcatagcatcgatggtctttacaatttgggatgtttttgcagtggctggtaccagttgtttccttccatgtttagtgcttccttccttcaggagctcttgtaagtcaggcctgttggtgacaaaatctctgagcatttgcttgtctgtaaaggattttatttctccttcacttgtgaaggtaattttggctggatatgaaattctgggttgaaaattcttttctttaagaatgttgaatatcggcccccactctcttctggcttgtagggtttctgccgagagatcagctgttagtatgatgggcttccctttgagggtaacctgacctttctctctggctgcacttaacactttttccttcatttcaaccttggtgaatctgaaaattttgtgtcttggggttgctcttctcgaggagtatctttgtggtgttcactgtatttcctgaatttgaatgttggctttgcttgctaggttggggaagttctcctggataatgccctgaagtgtgttttccaacttggttccattttccccatcactttcaggtccacaatcaaacgtagatttggtcttttcacatagtcccatatttcttggaggctttgttgatttctttttactcttttttctctaaacttctcttttcactttatttcattaatttgatcttcaatcactgataccctttcttccacttgatcaagttggctattgaagcttgtgcatgcatcacgaagttctcatgccatggttttcagctccatcaggtcatttaaggtcttctctacactgtttattctagttagccattcgcctaatcttttttcaatgtgtttaacttccttgtgatgggttcgagcatcctcctttagctcggagaagtttgttattaccaaccttctgaagcctacttctctcagctcgtcaaagtcattctccatccagctttattccgttgctcacaaggagctgcgatcctttggaggagaagaggcgctccgatttttagtattttcagcttttctgctctggtttttccccatctttgtggttttatctatctttggtctttgatgttggtgacctacacatggggttttggtgtagatgacctttttgttgatgtcgatgctattcctttctgtttgttagttttccttataacagtcaggttcctcagctgcaggtctgttggagtttgctggagttccactccagaccctgtttgcctgggtagcatcagcagaggctgcagaacagcaaatattgcagaacagcaaatattgcagaacagcaaatattgctgcctgatccttcctctggaagcttcgtcccagaggagcagccacctatatgaggtttctgtcaacccctactgggaggtgtcctccagttaggctacatgggggtcagggacccacttgaggaagcagtctgtctattcttaacgctcaaacgccatgctgggagagccactgctctcttcagagctgtcagacagggaagtttatgtctgcagaagttgtctgctgccttttgttcacctatgccctgcccatacaggtgttgtctggaggcagtaggccttgttgagctaaggtgggctccacccagttagagcttccctgctgctttgtttacctactcaagcctcagctatggcagacacccctcccccaaccaggctgctgccttgccgttcagtctcagattgctgtgctagcagtgagcaaggccccatgggcatgggacccaccaagccagtcacgggagagaatcaccttgtctgccggtttctaagatcttgggaaaagcgcagtatttaggcaggagtgtcccatttttccaagtagtttgtcactgcttcccttggctaggaaagggaaatcccctgaccccgtgtgcttcctgggtgaggcgatgccatgccctgctttggctcaccctctgtgggctgcacccactctccagccagtcccaatgagatgaaccaggcacctcagttggaaatgcagaaatcacccatcttctctgtagatcatgctgggagctgcagaccagagctgttcctattcagttatcttggaacgcccccaatctgttcagtttttgaattaaattgaaaggtagaccccatctatacaatttttaaatgagtcagcatggtgcatgacacgtggtagtaagtgctcaggaaatgttttatgaatattatcttacaagttaattaaatactttaaaagacaaaagcagtgctttacatgtgtttcatatgatttagttttatgaaacttccaggtaatattaaaatccaaagcatcctgattctctacatgttcacgttctgtgatgagggggatggcgagaagcaaagaatgcattttgtgtgtgtgcatgatattaattccatgaactaagtttgaattctattcaaatactgaataggtaacatccagtttaagacttttatttctgtttagaaacacaattaacttatggatctaatggataagcttgagaatgtcctcccaactcagagccctaaggtgtttatctgcaaagcaaaaataacattcattgtgtgttcccttgcaaagtttgtctaagatcaagtgaggtgataatgtgattgtagtttatgaaccactttgcaaaacatcatcattatttccctgtgaagttttttaatatgattatttgatgcataggtgtgtatataaaatatgtaacatgtatttaaaaatagatattcctgtctgttccagttggctaggaaatcgactcgaggtcttgaaccatttcacaatcatgctactgaggaaaaaaattgagagcacttggtttggtgagcctggcaagaaaaaatgctatggtaacattgtcattaattcctcctttatggatagacctccaaatagttgaaaggaggtagcttttgaggtactccagcttaaaaatcttttatttatttatttatttatttatttatttatttatttatttgagatggactctcaccctgtcacccaggctggagtgcagtggtgtgatctgggctcactgcaagctccgcctcccaagttcacaacattctcccgcctcagcccccagagtagctgggactgcaggcacccgccaccatgcccagctaattttttgattttgtattttcagtagagatggggtttcaccatgttagccaggatggtctcgatctcctgacctcatgatccacccgccttggcctcccaaggtgctggaattacaggcgtgagctactgcgcccggcctagttcattttttaatcacattctaaattctgttattcttcaggtgttatcaattttacctttgaaatgccttcagaatctttctcattctgaagatgagtttcctttccaattatagtttagtttacttatctctcccaggatattgcaattgcctctctttatttttaagcttctagcttcctggtagcaaatccattcccattgaacatgtatttgtttcctactactgtaacaaattaccaaaaatttagtggcttgaaaccacaaaaatgtattatcttacagttctggaagtcagaagtccaaaatgggtcttcagggctgtgttccttctgcaaactgtaggggagaatccacttccttgccttctccggcattcagaggccacctgcattcctgggctcatggccccttcctctaccttcatagccaacaagatagcacctcatcaaatctctttctcaccttttcttttgttttcacctcttctctgactctcctgcctcctcctttcccttataaaaacctttgtgattacattgagcccacccagaaattataggataatcccctcattgtgagatcattaatttaatcatacctatgaaattcctttggccatgtaaagtaatattcacaggtttggagattggaaagtagaccccttggagagccatcattcagaactcaagtgatgtcttttagtaagatgcaaatctggtcctgccattttcctgcatggagcactcatgacttcccaggcctcggcaacagcttcaaatttttctgatctcaacctacaattaaaaatatatattttacatcattatctaatttacacacacactcacacacatgaaaatcttcacaaaatttggcacttactcttatgtgtaattcactttcataatttctgttatagcctattaatttgtaaaatgctgtccgtgacccatttcacagagtttctggcctgttagtgggtttcaaaccacagtttaaacatcatataggctgtgtgtgcttcatccatgcaaactacttttagatcccaaacaggctgttttctttcatgcctcatgcactttaggctattcttgccctacaaagcttacatgccatttctgctgacaggctcaacacaaaacattactttctttagaaagactccattgatttcctccaggcacctgcacacctacgtcttgccagcctcccgtattgtctctgttatagcacttgccaggtagtctctcattctcctttctctctctctctttctttttctttctctctctcctgcacacacacatccttctctttctcctcctcttccatctccttcttctgccttcctccttcctttcctgttttcctccctttctccttttctttttatttcattctaaaagaaagataataagagatacaatagcctttgtagaaaaatttgaaaatacagaagaataaacagaaagctaaacctacctctaaacaaaccctccagagagaactaataatatttacacattttcagttaatctttttgatatctaaatctacacactttactgaacagaaataggttcatgctgtaaaattttggaacctgttgggatggacttgacgttaacctggatagtgagtataagttataaccagcaatttttgacggaaaaatacaaggcaacctatatattggtttaatgaatattcaggatatatagtaattaaagatgacttccatgaaaagaaatgtaaataacgtttaataaaataagtaaggaattcttccaaaattatacgtggcaaccaaaattatatttggcagccaaatttggactctcctgatgaataagatcttgtttattctttttttttgtttgttttgtttttgagacggaatttcgttcttgttgcccaggctggagtgcaatggtgtgatctcggctcaccgcaaactctgcctcctggattcaagcgattttcctgcttcagcctcgcaagtagctgggattacaggcatgtgccaccacagccacctaattttgtattttttgtagagatggggtttctccgtgttagtgaggctggtcttgaactcccgacctcagctgatccgcctgccttggcctcccaaagcgctggaattacaggcatgagccaccgcgtctggccatgtttattcttttgtaatcatatttctgatgaaaaacaagtttttatttggaattattattgtgccttaataccctattaagacagtttaccagggacgaaaccagaatttggagaaattgttttacttttttcaagctactagtccattctcaaagtgaggtccaccgtgcaactacatgagaatcactttgagggctactaaaagctcagattcccatgcttaccctgtcctactgaatatgtctttaatcatggagcccaggaatgtcccccttttaacaaattttgatgcgtaataaaatttgagcatcactacactaaacttataaaactgtaaaaatcaatgttctaaacagctatttgggagcactaatagtttgtgttaatgtaaattctccctagaaatcagttcctttaaaaaggcttaacctcaggagtctttagaaccaaacgagaccttaaaatatgtaatttaatcacatctttgtgcaaatgaggaaactaaaaagatgaaatgacctctcacaagtcactgagcaggtttgtagaagaattgaaccttttacccagaaagaatctctgattccaagtcctaagccctcttccctattccagactggagcaaactttactatatctgctggcttacctattttaagccactatttcatcacagtaaatgccactttaatctttgcttatttactttctaatgacaaatcctgaaatcaatttctttataaaaacgcattttggtgtgtgaagagaaacattcctggctttaatgtaattatgaaaactacagagccatgaaatctcctttgctaactgcatactgcttggagtttgcatgtaatttgtggttcataatgctcaagtttgcctgctggtgtactcagataagaggaagcagctagacttccaaattaaaggactctgatagaataaactgcatcaatatctctatttcctgaaaaggaaaaaattctgcttgtttagtgaggtgaaaagtaatctaaatagctgaatataatcgcaaacagaattcttgaaagtactgagaattttttagtaaagatacacaaaagaaatgctatacaaatgatctgtgctgaatgtatctggggttgagattctattccatttcagaacaacagtcattaaaaggtcataaaaaacatgataagcaggtaaaatgacttttcctttatctgaattattttggttgccatattttcagaagtttaaaggggtgctagctttttctttctttcttttttaaaaaatttctgtatcttttattcattctctgtttgaacatttagttccagtttgagttaggggtggtgatcttatagctaaacaccagaaaggctgattcttgttcaccattagttagcacaataagaaactcaagttatcaaatcagagagcactttcagcattaactattaataattgtatgagtttccttttactttaaaatttatgaatggtagattcaaagtgagtgataatgcaatgttatattcagagacaatttcactgaagcaaacaggataataatttattatttttaaatatcactatgataatttttttcctggatctttgataatttttttaaccatctggttatttatgacatcacattatatgtaacactaaaggaaggtagaaagatacttcttcagtgaatctctgctttcaacatacttttagaataaacaactagtagaataactatacatctggtattttttaagttcgtatttataagtaggcaaagcaacctttaccttcaggaagaaaacagcttctcacaagcgaattccattgcaccaattggaaagaagtgcccagtccaaatgtgaactagattcttctgtcttatggtcaggagttttgcaatactgttattaagtgacattattgaaaatctacaaataattggctttcttttatgaattcttaaaaaattttgatgacaaattttgcattatggtatttggatttgctatttattaggaaaggagttaagaggtacttgaattcagaatccaagataaacatgtgtttcagtaaatattaataaggttaaagagaaattttcttttgagggagaatataagtctcttgcaactgtgtttatggaatagaagtagatgatgcccacatttttttattgaaaggactccttggttacaatgacttgttcccaagcacttttgtcttccccctacccacttgcactctctctccctctcttcatccctccctctgtctttctttagaaaggagccctttgcttcctaaccttatttaacttgtttctggaaatgaagcaaattaaattttactcattaatgtgcttatgcctggagtatccatcttcttatgatgggagataaggctgcacttgatcctgtgttgcccagtccaccaccccttactttcatattgctcctagtacccttgcagttcatttaatcttaggagatactggatattacatttttggtacatccagttgatgtttttctgatggtttgaaagttacttgagatgaatttttaaaaatgcaaataaaaataatcaagtacaaacaaccactgggtgatctaggagttagtgtaaaggagatggcaagtacagaaacttttgttgttgttgcttaggaatagtttatggtggccatgttgaatgataagctttactatcccactaattgagaactgagatccatcagttacagctacaagttgtaggacagtagcatcggaagtcagagtttgagcacctctggataagcatttttttcggtggccaccttgggcattcgtctcaaattcatatctttatttagaaataagtggctagtctccctcatggacacactgaaatttataggataggaaaagcagaaaagcagtaacaacagacttattggaagaaaaggtagagttgtaatataatgagaatatatccatttatacattgttggttttagaatatctctccttagaagttttcatctaggattaaaataaagtatctctaacattcgagcttcttatctttccacagacttgcagtaacttatctacttatttgtattgattaataatgttagccttccaatacctcatttttgcaaccttgataccatctgcaacttgtctcttgtgttcttgtggttgtgtaatctaacctcttacagaatgcacaactctcttctacaacatccttaatgttgttcattcttaacattcttatgttcaaacatctcctgtgataaagtactcaccaatttctaatgcagcccatttttattagtttctatcttgagtcaaaatctatacatatccaatcatttttaccgttgagacaaagggttttcatcccgttgccaaagccagtttggagaaaagcccagacaacattttagtcatcctttgcctgcttttctttccatgacagtttccagtttttatttacttgtctcaatttgttgttcgattgccttggacattccatattgaagtgggtcctctggcagaagttttaaagctcattgttttttgcttgtcaactttaagcaaattggaaggccatagcagtaatcttatttccatttctggaaaaaagatgatatttgagcaaagaatgacaacctgtatcttcactccttgtaaaatacaattttattcaaataagagagattaacagtagtttgtaatcacaccttttttaaaaaggacatccaaaaattagatatcatacataacatttggataattctatagagatataataaacccaaatcatgaacatgaaatatgttgatgtataaaacattgcacatgaaaaagaaacttagaaataaagaaagagcagctaggagttataacagctgacaggtgttgcatgcttcctgtgtctgaggtcctattctaaccaagttacctgtgttagctcatttgattttcatagcaaccttaggtttccagagaaactcattttacagttgagaaaactggggtacagaaaggttgattgatttgcccaacatcacacagccagtaaggagtggagccagaatgtgaacacaggtcatccagccctagaattcctgctcttaacaattatcccacgttgatcagactgccagcatcagaatgaccaagggtgcttggagaaggtacacattcccagactcagctgccaaatctactaagggagaacttctgagaggagcactatgttaaattgccaaatgtaatttataaataaattcattagaaggaataggtctcctaaaacttccctgaaaatgaatgatagggaaactcttcactctatttttccccccagccagctctgtgctttactaggattcattgcttggttccaaaagagaagaaaccctgccccgcctgggcatgttctacagcagcttgcaaccatctttgggtactaagaatcatcccttatctttctttccttttttttttttttctttttgagacagggtctctctgtgttgcccaggctggaatgcagtggtacaatcacagctcactgtagcctcaaactcctgggtttaagcgatcctcccaccttagcctcccaagttgctgagaccataggtgcacacccccacacctggctaatttgtttacattttgtagagaaaggtcttgcgatgttgcccaggctggtctcaaactcctgggctcaagtgatcctctagcctcgggctcccaaagtgctaggattacaggcataagccaccatgcctggcccattccttcatccttctatgaacgatgatggatctgggcaaatctagcattacacccttgcccatctgcctgctctcacatttgtgaaataattcaccaggctgagcatgtagctgggctgcttggagcagagggaagaacacacagggatcagaccctgaccttattagcacggcatgatcatcatgcctggcataatccagacagagtggcacccagctggagaagtttctgtctttcctgtaggagaaggatcagtagaggccagtgcatctgctccctgactctgctaccaagcaattcaagcagtagagtctgtttacagggtaagaaaaatacatttgtctggcacacaatccctgaaagaactttttgcattgaaataggaatttgaattatagtcagactactaattccctttcaggtttctcatgccaacagtcatgttgtcagtgaaatttaaatgtgggaaaaatgcttttatggactgccagattgtttggcaaatgatttaggtctacttggtttatttgtgaagcagtgatttttgttaactgcaaaataatatgaaaataaagaattaaattttgctgtatacatgggttttatttctccaacaataacattcttagtcctacctcgtctttcttcttaaatttaaaatgtcaatgtacagatgtatgctatatagcatatacttgcttgtctgctttctttttcacacataaatcaatataggtcctttctcatttgtggctttttactcttattttctgttgatctggaaataatatggttggttcatgtgtaataacttctggaaatttgttttctctgccttagcagagaaattaacccctaaagagaattcatattgaatacattctgtagatgttattctatatttaaattgtgtcaagttgtaataagagtttggccttaattttacatgttgttgtcttttggcatttcagtcaaattttatcattttcaaaagcagcacccaaagtgacagtgttaaagtggccctgggtgcccatgggactcaccctctgtacaccacccaggcccttctaccttccagaggggtagcacctcctccacagaggcgagtccacaattcacagtccagtcctcaaactgagatgtctgcctttctagcttcttaatccttgcagctaatgatcaggccgcagttctccccaataaattccagttctgttttgaatgaagatgtataaaatgaaaaaagccatttcccatgctgtatgctctatcagaaagacttctatcctcagaattggtaggaagtcactcttcagacttctgaggtttatcaagcctggcccgtaattgttgttgaattgttttccataggtgcatctctcaatcctttcgtcttctttgtagctggcctctgacccacgcctctgatttcatgtcctccaattatggatccgagcgccagtctcattggtgtctgatcagaactgaacggaaaagaattactttaacagcaattgaagccatttctggatgatttcaacatatccaaaaaacaagtcattgaaaagccagggtttctctctaattagctgtgtgatggtgaagcctcatttgctgttatcattgatcttaggaggccgtgggtaactttgtgccttgtaaagtttgatattgtataatctcatacagaaatgtgaggtcactaaattcacacatgaaagtacactaggctgtctgaggccttggtctgagtgtcatcatttcccaaatgccagacaaataggcttaatattttttaccaagttaaccacttgtgagacagtactggcccactcaaaattgcttttgatgtttagatactccatttgaatgtactatcatcccactatggttttagaattatttaagatgaaatattattttaaaagcaactaataagtaaattggacccacttataaagagaaatgtatatcattattaatagtagtactatttcaggtcaaatcaagaagcttttccaggccgggcgtggtggctcacacctataatcccagcacttcgggaggccaaggtgggaggatcatttgaggtcaggagttcgagaccagcctggccaacattgcgaaaccccatttctactaaaaatacaaaaattagcccagcatggtggcacacgcctgtaatctcagctactcaagaggctgaggcaggagaattgcctgagtctgggaggcggaggttgcagtgagccgagatcacgccactgcactctagcctgggcaaaagagcaagactctgtctcaaaataaataaataaataaataaataaataaataaataaataaatagaaattttaaaaaagagaagcttttccaacgttgacaccctttctctggtatcttctccctggctttcccctgctcttccgagaggcagccattttatcctcctgtttcatatctgttgcacagccagctatgtgctcgctctctctatggcgtacatgatgagatgctgcagcagcttctagttctctagcatctgatttctacattttcatttccctttttctttctatctattttagggagttcatcaccagacataatacttactgattcttgtcactcaaagtaatgtgagatgcgggaatctgctttaatcttggaacactcatataattcactaggccctttgtttccatgaggatcaaagcaatcataaaaataagaatgtgcagaagaccttaaagaaatcagcaagcataatcagatgatagtcatgaaaagaatttaattgcgtatttcatctttgcattctgttctccttttatgtaaggaggcatggagagcgaaaaggagagcatgtgaattctggctgatcctgaaggacaaatatctttattttctcttctcccctgggagtgggatgagcaagaaacaatgttccactgtgcaatccagttttgtcttaacagacactttctactgggatctgacaggctcgcttcgattttttactcattaacatgatcaataatgatgatgctgcctctagcatattacactttacagagaacttttctcatttatggcttgcagttcaactcactattaggtattgatttcattttggaaatcaggaaacatgcacagagaggttagatgatatttctgaagataccctgcttgtgagtcttagagccagggtaggaacccaggtgttctaactccaaagccctttctttgtgccacacattgctattactgaataaaaaagcagagggagtctcatttattgagcacctagtatgcacaagaagcattacatacgttaattctcacagtaatcttgagaagatagatgatatcatcattattttagctagaaagcaagaactcaaaggggtttaattacttgcccagggtcatataactgataccatgtcaaatattacattttctttcctccattacagattgtggatcctcctctggaatacacaagaatttgttcttggtaccttccctccaaccccaccatcccctcggatactatagttttaaagatagggagggtgtgatcatcatactgtgcatgtgcagtgcctggtgaatttttcaatgccaaacagaagcctctgcaatacctgaatattgtttcagttcttacaatgtaaaaatggtagaaaatgcacaaaagatgaacatcagtgtcagcctttttgccatgattgtgattttcgtgtggtaacaaacacccctcagcccatcaaaatctacccatcactggaaacctgcaccaaccgtccccgttcctggagcttacttcagcttacattgatttgttttttctctgatttctctagtacttacgtcatactataaacacttcacacacaaccaggctctcagattgctttgtgtgcttcattttgccagtttatgggaaatagaaattttctgatttctaggttgtatctcgtagatgtttactttgtatttttctcagtaccccacacaatgctaggtatatagatatttaatgtttggttggttttcattaagaagttaggttaagaatattgattaaataacataatttttgctttgtatcaattttgagtccaaacatcaatttcacctaggcactaaattgtttgggataagttaataactagttttattcttggtttaaaactgtctacaaaaaaaagaatagccatttgatagatttttttttctcgagacagagtctggctctatcacccaggctggagttcagtggagcgatcttggctcacttcaacctctgcctcccgggttcaagcgattctcctacctcagcctcccaagtagctgggattacaggcatgtgccatgatgcccggctaatttttgtatttttagtagagacagggtttcaccatgttagctaggctgatctcgaacttctaacctccagtgatccacccatctcagcctcccaaagtgctgggattataggcataagccaccatgcctgacctagaatatttttgtttttatttttatttttgaagatatatgtggattctcttgaacatgaaaacacaaggtcaaatgggtgagaggagtgtagtcaatgaagaagacaaagataagaaaacataggtacaggctgggaaacatggccaaattctgacatgaagggatcaaaaacaaaagaataaacacacatactaagtataaatgtaaatataaaattggatagggatcttggagccaaataaaaagtagcctaagaaatttggactttattctatggccagtaggaagacatagactgtttttgaacaggagtgagtggtggtacagatggtgatggaggtagtggggtcatctctaaacttcaatacctcaggggccagtcaacaacataaagacagccagataagagtacaaaagtggcagctgctactagttgtagtcctccatggccacacagcaatgcaggaaccatttttaccatcttttgaaatttttcaaaacaaattagaaatctgggcttttgtgtaaaaaatttacattttaaaatgttagcttaaggaattttaaacacgacgttaatcaaacaggccacttctgtgaggcagataccagcctgtgatcttgacctacatgagtgacacaatcacttttcaaaatagttaactagagaaagctggtcagaatcagggcaagaactgcacatggcagagaaatattcttattttagaggcagactcactggttttattttaaaatgaacatgtttacagtgtgtaaatcagctgagctttagaacttttgcaaacattcaactctttagaattgacaatggtaatataacaagaatctttaaaatacatcagaaattaagaacttgctttataaaccctcacctgactttaaacataaattaaacaggtgctagaggacttttgagacaataattaaccaagtattcattgataaaacacaggcataaaccaggacattcttgggcaaactaggacgtatggttaccctatctacttacatatagttggaattctaaaataaacacatttttaaaatgaggttaaagtagcttgaagggttaataactgaaattttcttctagaattgttataagataataatcctcaaaattgggaagcacagttattcccccagcagcacatgtaaaaagaatgtaaatgtagccacatcacagtgaaactacagaataccaaagatgaaaagaagctcctaaaagtagcttcagagtaatgatagttcatatgttggggacaaatggaaaagagcctaagaaacttggactttatttcctagccaataggaagacatagcatggttttgaacaagaggtgaatggtagtatggatggtgatggaagtcatgaggtctttatcacaataaagatagtgattaaaatggaacaataattagatttacagcagacttttcaatggtatcaactaaagcctgaagacaatggaatgatgtggtaaagtgaagatagactataactagaattatatacccagctaaacattattcataagtaagggttaaacaaaaatatatttggacatacaaaagaagtatttattaccggcagaccttccccaatgggatttctaaaaaaatgcacttcaaaaacatgaaaggaggatttgagatacaagaaaaacttgtgagcagagaaactggaaaacatgtggataaatacaaataaataatgtctgtgttaaaaagtgtctgacttagggagtaaaaaatcaaggtagtttaaaatataaaacattgtacaacattatgatttatgataggaatggatgactgaaaaattgaattttggagaatgaagttaaagatattgcttgttttttttaaatataaatttctacattttcataatcactttattataggcataacttccaaattaataaagagatgaatgagattagacaaaatagaaaattttcaaccaaagagaaagcaggatatgaaaaaaagaaacataacataatcagaccaaatgtcatagaacaagatagtaaatatacaaataaatatagtggttattatagaaaatattagtgggccaatttcttgataaaaggattctgatccactgtatcaaaaatactatgagaaagaaaaatatattttaattcagagctgaaaaggacttagaaaatgtagtttctcatttataaatgagaaaatcaaagcctagagagtcgagtgagataaccaaagtcacttttctaacaagtaccagagattcaaccagaatctaagtttcctggcttctaatactatatgatctattaaattatacttttgtcttcttttccacaaaaacgtatttaattccacaggctgagtttcctgtgcatcttttttttttcttcttgaagatactactagccttttctccaggactaaaagtattttttttttcctagagggtagacaaagttgtgactgctgatgagaataaaaatattgcaataaagaaaaatcttaggtgattttttttcttttgctttgactgacctaagcttaaggaaagataatttcttgtctaattgtatctttaaaagtacggaagggaattaatgaaggaagaagaagaagaatcttgaataggtggaacattttcagcttgttaaaatttgtgagttttgatgttgtgattaaagattttaagtgccggtgacacagtagattttggagaatttcattgactttagttttttgcacaagttaaattcgagatatctgtgtgtcccatgatgaaaatatggttctggaatacagaagtgtagtcaaggtttcctagtaagcggactattatatttatagattacatttcaaattgtgaagaaagtgtagtatctggtagcatcatacaagacgatgagagagaatgaagatcagaagcctgtacagcaccatgaagaggtgagcagaaagggaagcttgccaatcaggaagaggagctcgccacatgaagaagaaaacttagagagactaaagaatcaggagagcgtcatgccctggaagagtgaatttaaagaaataaggggttagttacatatgtatacatgtgccatgctggtgcactgcacccactaactcacatatgtaactaacctgcacaatgtgcacatgtaccctataacttaaagtacaataaaaaaaaaagaaaaggaaaaaaaataataaataaataaatacataaaagtctttcagcaggaaaaaaaaaaaagaaataaggggttatcatctataccatgtgttttagaatagacaagtaagatgagaaccaaaagttaaactgctggatatggtagtgatgaggtcattgattattttagcatgaacaatttcagtagagtcttagcactggacacagctacaattggttgaaaaatgaatggggtttgaaataacgaagctgaaaaagatctaaagcacatacatgaacaaaggttcaaaagcgagatgataacatcaaacagaaagccaaagtaaaaaaaactataacctaacttcttcactattcaacctaatattcagaaagaggactagactttggatatttgagaaaagctgatctttggtatgacctgtgtcacctcccagcactgtgacttagaactggcacctaacctctttatttctcagtttcatcatctaaaaaatggtctactgcttcagaataaataaatggcatgatacatatgaatgtgcatatatgtaacaccctgtttaagtctacattcttgatgttgtttttataatattttattggtagtttgctcggtaaaaagcctaaacttgtggtatactttgatgttttatctaaaccctgtttttgatcgtgctctgcccagtcacctgtacccatccccaaaccatgactcgaatagatctcatagtatttccagtcattgttctcttattaaaaaaaaaaaaaaaaacaactcaggcagaacacaggggacttttagggcagtgaaactactccatatgatactataattgtgaattcatgtcattacaaatttctgcaaaaccacaggatgtaaagcaccatgagggaaccctaatgtaaactatggactttgggtgataatgatgtgttactgtaggttcatcagttgtgacaaatgcaccactcgggtgggggatgttgatagtggaggaggctatgcatgtgtggggctagggtgtttatgagatatctccgtattttgttcagttttgcgtgaacctaaaactgctttttaaaaagttgattattaagacagaaacaaatctcagtactgttgagcccagtttaaaaaggcaaaattgtcatatccagtttaacaataatattcttcccttaccataaatctgactatattctcagcgactggtagtacaatcaaaagagcagtttgatcctccctttctgtcccttctttttgtagctcttgctgtttcaaaatcagggatgaagaagagctgggagatgaagggagggcagatgactgtacgtaacctgatgtgcaattacaattctttcttggcttcttcagtgaagcctgtcctgccacccacaggacaagcttctgtgtgacagacatctgaatgctggtcatctgaatgctggttcccttatggaggaccttcagggagcctgttagggctctctcgctgcatagtgccatgacatggaagatttgctcagattccttctcttttaaaatttcttcagctcccttctgcccctgttaatatacatcatagctttccacacctcatccaggagacagctctcttggagatggcttaatggcaaaacgtctcaagtgcagctacctgctgtagtgtttacagatccatgggaaactcacataatctagccatgctagcctgtgggaaatcaggcttctccactgcctccccttcctcaaccctgctgtctctctccaggtatcaagtactcttgcacaaaagccgatcaaaatttcattgtttaagcagatactattcaatgagcccaatcggcacatggctttgtgtgcatgaaagtgcccatccctttacaaagagtctggtttgagtcttagttgcctattttagggcaatagtaaaagtcccattcaaaagcctgttatcctttaaaacgcaatgcatttgatctaatgcaagcatttcttattgtgttctgtgaagaaaaacaattctcaaccttgactaaaagctgtaagctgcctgcatttatgtatttatcctgcaggttttgaaaaaattgagtgtaatcaaaatcccactgggaaaaagtatgtcaaaaagattaattagaaggaaagcaaaaatgatgtcttctcctgcctttgtgttaaacattcttagaaaacaagcactgaaataaaataagtaaagatgcctctatatactttcggctgtaaattttattaaggtcttgaagagagttcctctgagtgtttaaatagcatttactgaaaaccatctccaactttcatgagcagaaacatgcaattgttagatctgtcagggtattactgaaaatggagtcaaaggccccttataaaaaagctatctatggcttttcctctcttccaggaaagatgaattgccatggtaacactgccatgaaataataggtcaggttttatccttctgcctcaggcttattctattaggttttacttagaagtggatgccattgtaaaatgaaggtttttggtatttcaaaactaaacatcatgacaagaaaaatctgatcaataaaatctgctggtatgaaaaggttggataaaggacaacaggtagggagttaaactgattggagaactatttagaggctggtttattagtactcttctaaaatgtgggcttgtttcacagatgcttgtataactgaatatgcataaatgaagccaggctgactgcacaagatcagttgggaaaagtggtttgtaaattttattttaatggaggattaactgctctagggaaaaagtttccatttcattccgaatgaaacaagaaagcataaaatatttaagcttcctatttttcttactatttttaaaagacaaattcaatactgttttgtgcctatttatggaaatttctaaaaatgcaacttgggagaagtattaatgacattacacaaacaacatggtgtgtaataattgaaattctgttgtttctgttgtttgggggagttgtgtctcagtatatgcgtcatgactttacatttttctggaacagtatctcaatcattttgggatgaaattccaacagaaactaatatatattttttgtcatatcaagcaacattgctctgtccttctaataggacatacattagaataagagagaaatagatatctagtttttaaagtaacaagatatatcaaaccaacttttttgaagagtttcatttaatttaaatgtaagttaaatgtagaacatggtagtggattttagcataacatctttcctgaattcacacagtgagactatgtctgacttctccatagaccaccttgaattttctgtagttttttcttctgtaaagtactaacagtgtgtgtgggtagctctgagatttatattgccttcagtctgatcatgaagattgcaaagtggggtcagtgactgtgctagtttcctagggctgctataacaaagaggcacaaactgggtggcttaacacagcagaaatttattgtctcacagttccagaggctggaagttctaaattaaggtgttagcagtgccatgctgtcactgaaggctctaggggagaatccaattcttggcagtccttgtcttatagattcatcaggccagtctctgcctctgcctttacatggctttctcctctgagtgttatatctctaaagtgttatgtatataaagattagggcccattttaatccaaagtgacctacctactgggtacagggtatactgcttgggtgatgggtacaccaaaatctcagaaataaccactaaacaacttaattcatgtaaccaaacaccacctgttccccaaaaacttattgaaataatttaaaaaaggaagacctcatttaatttggttacatctgcaatgaccctttttctaaataaagtcaccttcataggttctggggtgaggaattcagtgtatatttctgggggacacaatacaacccacagcagaaactgaattgagggacttcgacactaaataaattatctctattacaattttaaattgctatgctgtctagttctttagggaaataaatggtgatattacttgagttatgtttcattactaatggttactctcattttccctttcccttcaactttaaatttttgtagatatatagagaatatggtattcctaattaagtgctctcaatgtgtagaattttaaaatgtacaaatatggttagaataggtaaaataaattgaatatatacctatcacagttcctaacttgtaataggtgttccactaaatgtttattgaatgaatcaatcagtgttaacattaaaatatactgagcataatttaatctgtctttaatgattcaaaacattttctttgggcaaaaggtaactaggtatgaattaagagatccccacttgcctgagtgctcaatgactaagtatttattctatttcacttctttatgtccatttggaaactcattaggttttttgtcttggattacactgttcccagcccccatttcttttgactttcccctttgggttatcacatattcttttctatagcttaattaaactacttctgttgaacaattaacatcaatgtgttctgatttggtttctccacctataaaattgtctactttatcatgtatcaggattgtctgtcctttgatctatttttctctgtctaggtatccaataaatgtattttgatcgtggttatattatttgagttgtatttctttactaacggttactcccattttccctttaattgaatacaaggagaagtaaccactaaaacaaaaaacaaattacattacaactcctaccttacaaatgactgctatttcctcagttttaaaactgaatgttatttctgcatgaccttagaaggttttaagaattcagtacatacagttttaaaaaagaaagatttcattagaaaaacattctaaggcagaaacagagtgccaaaattcaaaccaaaaaagttttaagctactacttatcaagctgtgaatgttttctattttatagttttttcttgacagatattcaagtatttgttaatcaaacttgccattaatgccaaaattcccctaaaaacatgattaggaaatcaaaatatttaagctaactgaaataatttttttttcaaaaaaaaaaaaaaaagaggaaaatgaaagctgtatcactcatggaagaaagtttttattttttaatcacatttttatccctcattttctctctgatatttccagttgtttttttcagtcacgagaagcctacatttatggaaaatcagcaagtataaccagctattagcatcagctagggagaggaacaacacaaagccaggattttgagccagcttcctgggcaaattgggaaaagataccattttagttagttacctgagactgttcaagtttaattacattagtggcacttgacattataaaatgtttttttctttcagatataaccttcttccatcattagtaaacgtcaattataatgaagtgtttttcccacttccttttcttcctgatataacggaagaaaatgctaatgagtttataatcctgaaattgttttcaaagccaaaacaaagtcagcttggtgtctgtttattagcttaattttattctttatatttggagaacaaattttctcattttgtttcttactatattttccctacttagtgcaatttcttattctccctgagagcttttaaatgataaatattaccaattagattgtatttctgggttcaaatcagaatgatgttgaagatcctgccccttgctgtgacttacgtactatctgaaagcttctattttttttttcttaaaagctggtttttccctctctcttttttgattttgatacataatggctattcaatccatgggttctaacagtttcctgtaacatttcaatcagaatataatggtgacttgatttcttctctctcaaagattaaatatgtccacatatgaaattgatgcattttataacaaagaacaagtttctttactgtcaaaatgaaattaacatcttatgaaaatgggacaccatcactggaagaggtcaagaaggaagagagagataaagtcagttttccaatacaacattattcagtgtctgtgctgaaaacatgcttgacagaaaaggtctgggtcaccttttagcagtgtcttggtatactgtttgttttcccctactgagaaattagggggaagctgtctattgtagtgcagagaaggcagcaggcatggggtcccaacctgtaagaatgctgtgtaatcaatgccaaaaaaaaaaaagtgtgaccaagagaaaaagaaagccatttaaagttactttacaataggcaaaataaaaatggtaaattacatttatagataatatgttctggaaaatacgaacccaagccaaatgtgggaaaattttaaaatagactgactagttataaggggttatgctccccagaaagcttacacatatcacaaaagctttgcttatgcttttcattttaaacagtcttttgaagtttggtcctggcattttatccatattgtctacctttcttctttgtttcacagctggatatactgctaactgaattaaatccaatgaatatacaagaatatccaaataagttcaagagttgcttctttctgcctaatttgtatatttgtcccaatgagatacactttacgacatctatgtttatccctagcatctacatttttattttaaaatatttataaaatagtaagcaaagtataataaaatattcaaatagtggccaagtaatttctatcatatagtcatgcaattatgcaacattgcattgttatggctgggattcaactcttaaattcattaaccatttatttaccttttcaataatttttactattagaatatttaacttttttagtgatttcttagcaccgttttacatattaaatatattaacctttggtctctctggtctaatgcaaatatacttcccagtttatcatttgatgttctatcattttaattctactttttttatattcaagggattgacagattttcatgtggtgaaatctttactttcttttttgttttctgccattgatagtatgttctgaaagatcttcctcacctgttctacattatttctgctattttgagtgctataatctgttttcatcttacttttgaaactttcttttctgtaaaattaccaaataaataccttgtaatcaggccagccttacccctgctccaagagtagaatataattgttggcttcacaaaaaatcacactcttagctaattttcagttccattttatagcctacattcttccagaataattcactgattcccagcctccttggatcactcttctctaaactttcaggagccgaataggatataacacacaaattgggaaagagttgtaggcaatctttagtttcacactgctgttcatggtggggtgtaagcatctaagcaggtacacacctatgggtgaagaacagcaaattcaacatgagcccttcccaatagtgaccttatgagacgttaatttcattttgatggtaaagggagctgtttctgtgtgcaacatgttagttttgcctccaaggcctgttaaatcttaggggtagctgggatgcactctgcatccaaaggaggcatctctgggataagagagtccagattgatgtcagaaagaagataatatttctgtccaaactgctaagcatctaaagagtactaggaaagagaagttagatgccaatctccagggaaagtggcgaagagagaaactgaagagcatttgaattataagtgatgccccaggtcctgaggagggagtttgagttgaggaacaattactctaattacactataaggtatatgtgatgtatacaggtccattttggtaatgtatctgcctctgattcccaaattgaactgttatatgccatctctcttttgcaaatgtcaaacttctgtacttgtaagctgctgtctttatcttgtattagccttgctgtcccacatctaagtaataaaagctagtacttgccatttattgaccaatttttgtgtgctgctctctgtgggaagcactttacatgaattacttcatggaaccctaacaagcatgctaaatgttagagggatttggtttacagaggttcagtaacttggccacattcctcggctatctaatgggagagaaggacctcaaatctggatctgtctgactcaaacatacatacaaagcaggtttttttattcccattttacaattaaataaactgagactgaattgcaagcttcttaaaagcagggacctttttataaacttccttttttccccccacagtggcttgtacttggtagatagacaaatgcatagtggtggagctaatatactcctctgatcttaaactgcaataaaaagctcagattttaaataaatatgatctatctttttattttgttttctatagtcagatgctgcttaatgaaagtaaacatatgtagaaggtactttgagcgggttctttaccaaaaaaagaatttttcagaatattgcagaactgcaatataaaaatcattaggacataaaagtggtttaaaagaggtagcaacttatcctagatcacaaagaaaagaacagaaacaaagaaacaaatgaaaaaaaaaaccctctgcactttaactccatcctcccacattctgactttgtgttattacaatttacatatatttatattgcctttctcttaacaggttgctgtaactactgttgttttcatagatttgtcttttgggcttcatactagagttatgaggggattgccaccacaattgtacagtattgtcggtttgtctatgcgcttaattttaccagtgggttttatacctttaagtgtcttctttttgcatattaatggagtttgttttcaaattgaagaactccctttagcatttgtagatgggtctggtggtggtgaattttctcagcttttgtttgcctgagaaagacttcatctccttcatagataaaggatatttttgctggctacagtattcttggatggcaggtttcttcagcactttgaaaatgcagtcccactctctcctggcctttatggttttcattgagaagcctgttgtcagacaaattggagctcctttatatgttatttgcttctttgtacttgctgcttttaggattctccagttgtccttgacctttgagagtttgactattataagtcttggggtagtcttatttgggtcaaatctgtttggtattccctgaccttgctacctctgattatttatctctttctcaagctttggaaagttttctcttattatttctttaaataagctttctatcccttgctcctgctcaactcttttgaatgccaataatttttagatttggtcatttgaagtacaaatatagagtttggtagaagaaataagatgtagtgtttgataactcagtagggtgactataatttacaataatcgattgtatattttaaagtagctaggaatgaataatttgaatgtttctgcataaagacaaatatttaaagtgttgtatatcttaattatactgatttgatctttacaaattatataaatctattaaattattacatgtaccctgaaaatatctacatctattatgtatcagtaaaaaaatcatttttaaaaatcattaggggaaacaagaccaaaaaagatagacagctatacacaacaagtacattttagactctattgtgactctttttggaattattaatcacttcccaaaaatgtattgccttatttctgagagattatcattttttttttattctttaggacacagcaggccaggaaagatacaggactatcaccacagcctattatcgtggagccatgggctttattttaatgtatgacattacaaatgaagaatccttcaatgcagtacaagattggtaagtcagagcaaatactcttattactgataatgatggttctccggtcaactctgtctttcttcccaaagcagtgaccataccgcaatgtaatatatgtgtttacattacactacaatcccgcttgtgcttcatttaaaaaaaaatgctgtttatgcacagaagcattattcagggattgataagaagtcattctgatgatttttctgcattttgttcattccagtgctttgcattttgtcatcatcgcttccatggaaactagtgcattgcttttgattttttaaaatataaataacgaatggtttggaagtttactgatctaaaatagggatctagaaactatggctcttgcgccaaatctggcccactgcttgtttagtaaatcaacttttattagaatacactcccctcactgttgtctttgactgccttaacaccaccacagcagagttaagtagttgcaacagaaaccatattgccggtaaagcctaaaatattttcgatctgtccatttatgaaaaaagtttatggaccccttatccaaaagatttgttaaataggttattcaaactgaaaaattttgaaggactgagataaaggataagataaaaccaaaactttttctgactcatagctgcatgaaactatctgaaaatacttctgaccctgatgagtgtttacggtggggggttattcctacggctacagtatccttcattctatcccaccagcaccttgagagcagacactgaaaagccagtgagatctggtcatgagctcaagcacagggctaaagaggacggtttttctgtggaaggagcgagaatctaggtagggctttgtgtgacattaggaaggaaatggagctcccaaaatggagttcccactggtggtggctaggactgactgaagaaataccgcactttaactgtaaatataatcacatattatcttatgtaaggaaaactttgacaatacataggcaaaacagacagcattctttttttgtttgttttctatgataatattatccaaaatgatttttacatatatatcagttcagtgagggtcagatactcttaaaaatatttccatttgcttttgcttttttctttccaattttaattgttcatctaggaagacttcttatttacacacacacacacacagttacaatgcaagaaataataccattggcaatagcaattcaaaagagaaatacagggttataaactaaaaaagacaagtttaagatgtatatgaaaacataagtatcttccactgaggaattcagaagaaagcttaagtaactattctttttagtaaactgaatgttgtaaatacaccagtatttctcaaactaatttataaactcaaggcaatcttaattaaatacagcagattttgtacaaaatgaaatgaaatagaaaatccagagataggcataaatctatatgaggatatagttgatgataaaagtagcattcaagttagtgacaaaaaggttggttcaattaagagtgttatgatatctagttaattgccacagatagcctgaaacacatattgctatgtaatatggtaattttaaccttgactacttcctgtcttaaaatgttgagatccaggaatcccaggccagaagtgctattataagttttccaaaagaacaagatcttaaaaacatggaagacctctgcccaaaattcctgcctcatcaatgcctgctgaattaattaaaacttcctcagcctgactttcagacataccacgtaatggtgccactatatcttcatgccttcatctcttactattctagaagcaaactaaaccattcattgtttctgaagcccagcttaaactttccaacatttgtgcttcttttcttctatcctttttttctctgctttgcatgtctctttcctcaatctgctactccatctgccccaaggcatatagatttgtcaaaaaccaacaaaagcctgttctagaaacaaacccttacctacttttttcatccaaaattagatgatcacttgatttattagggttttttaattcattcaacaagcacttattgagcacctaactttgacagccaatccatcagacatagcgtttagtacctatgccagcatttactatctcagttaatagatccaccatcacccagttatctgatgtagaaatatgagcactgtcttttatttcttcctcttttacaaatagaatctcattgaccaccaagtccaatcattttgactttctaaatgcctctccaatctattgctcttttttcttcctattgccaatgtgttaatccaaaccattcatttaggagtcttttatcttttctccttatcttcaggttccaccctctacaggtgatccatcttattgccatcagagctacataagtgaaccttagtacatctcgggccttaaaaataaaacttccagtaatatcttattatgtacagtagcgattctgggagcacatgttaatcacctgtagagctttgacaacatatacaagcccagactccactctggatctactaaatcaaatctcccgtgagatacacgggcatatgaatttttcaaggctccacaggtgattctgaagcccatttctggttaagaccattgatttataatgaaatccaaactcactaacatagtggacagtgcaacctccaggtatctatttcactgacatcatctcctatgactctcttccatacgctctatgtttcaactaaacagaaattttctcagcttacctgaactccatccttttactacctctgtttctctgcctgaaatacttcctctgtcatctttaaaaagtctatttacttttcaaggctatctcttttacaaagctttaaaagattaaaagatatctctaccccttttcctacctgctcccacctttattcataacagacaacactatccacaccctcatctctgcacccacactaccctggcactttctgcagatcacgtaagacctagcggactctgctattatttcattatattttcattaatcatttttccccattacagaatacagtacaatacaatacaatatatgcactcttatttttttctcatttctttatcgtggtaaaatatatataacataagatttactgtcttaaccattttttctgtatgtagttcagtagtattaaatacattcaaccatcaccaccatccagctccagaattcttatcatcttgcaaaacttatatttaaatggtaactccccatcactctctccctgcacccctcagcaaacaccaacctgctttctgtctctacgattttaactactttaagtagctcatataagtggaatcatgcagtatttgtcttttagtgactggcttattttacgtaacatactgtcctcaagtttcatccatattgtagcatgtcagaatgtccttccattttatattttattatatgtaataaaatatacattatatataacttatatgttacatataataaaatatacatacacacatacacacaatacgtgttacataatgtacattgtgtgtatgtgtatatataaacacaaaaaatattgtattttatatttatatttatatatatacacatatacatatactatatgtatatttatattatatatacacatatacatatactatatgtatatttatattatatatacacatatacatatactatatgtatatttatattatatatacacatatacatatactatatgtatatttatattatatatatacacatatacatatcctatattaatctaatatatattttgaatagatgatctaaagtactaaacagaattacatcctgatttcccagcaaaaaatacagaaattacttcaaactgacatagccaggaattaacggttgtattcttcctctcaacaatagatttaagattgtgtgtgtattgccgctatggcaccaattatatttatcttttcgtttttcttaagtgtatacttgtcttaagttcctactacattagaaactatttgtagggaaagactatcttatttatctgtatttcctttttgacataataactagcacaaaatggatattttaaaaattattattaatttcaaaagtaaaaaaaatcagaaatcttaagaaatgtttaaggaataggaatagaattgtataataaaagaaaaaagccctttggggaaaaccattccactgtagctactaaagcctactctacatgtacagtataattgaatggtggttgtgggtgaggaagcttgctgatattcagtgatggccttctacaacaggaaataaggtattctgaaagaaataagcacaaagaaacacattctttaaattactggtctccaagtgctgatcttaagtgtataaaaaatacagaaaaacatatctagcaaaaagaaaaattaattaaagctgagctgcagctaaagtttcagctactcttcccaacaaaatgcactttgattattcagaaagaaaaaaaagcttgctgactgtgatttctccaaaatcctaaaactgtcttactatataggaagaattaaagttcccttttcaaaaaacattttattacacaaaaattctggtctgttaaggagaagccaagtgtattagtctgttctcaaactgataataaagacagccaagactgggtaatttataaacgaaagaagtttaattgactcacagttccacatggccagggaggcctcacagtcatggcagaaggtgaaggaggagcaaaaacacattttacatggcagcaggcaagaaagcatgttcaggggagctgccatttataaaaccatcagatctcgtgagacttactatcataagaacaacatgggaaaaaaacccaccccatgattcagttacctcccactaggttcctcccatgacacgtgggaattattacaattcaaggtgagattcgggtggagacacagccaaaccatatcagcaagcatggagattcagagagagtagcaagcagcgagctaacagattattttgaggaaatggaagctatctcttttttgaaaacacattagactgtgctttgaattttccagtggaattttatttaaggagttaaattatcctctttggccaaattccccagttctgtaaaattaatacaaaattaagctcactgtaagcctatttagaatttatgtagaatctataaattttcaaaaagaatgtgagaaactcaacataaaaaaatgcatacactgtggttagtaaaatatgagcagaaagtaactcccaagaatcaggatgatggtttgtagctgtcattcctttgaaacagagaagaaaaagctttatgtgctaatagtttattgggacatacagggcctggaagcaagagtgaggagaaaagggagcatcagggaagagagagaacaaacatggagggtgttgggatttgcaaactgatctctacttggtagcaagtataactgaccattgatctcacaggaacgtcttcagaggtgctttatgaataatgcatctcaggacagactatctggtagaaggaaggaagaactgacccactagcttttctcttctattggtccaatgttcacttctgggactttaactcttccacacttcccagttacacatatatgggtgactcatggctcagcagcagcaggaaaactttggtgtgggaggcaaggggtctgtggcattggcctgagataagctgctttgggctgtgcccatgtcatgataacacaggtgatagtccagaagagcccttgcagaagtggttagcagaaggaatgaacaagtgaccaagagcccttcagacaggtgagtccaggaagatctgaggggttgcataaaaggtgtcttatagagaattttatttatttatttatttatttttttctgttttgttttttttttttaaattatactttaagttttagggtacatgtgcacattgtacaggttagttacatatgtatacatgtgccatgaattttaaagcttaagaaaatccaaagggtcaaacggttattgtgcttgaaatacaatttggttatgagattgctgaaaaccaaggtaataaccaaggccaaaaaaatttttttatattttatttattaaacatgatatattatatagctctcattataggaaaggagaaaaaacatatcaatcttacagggcaataagaaacttcaaaacagtttttgttgaatttggatggaaatgctttttatttggggcacattgggtttatgttaacaatagcttttataactagtactaaaaaggccatgactttagactcatttttttctttcttaaagaagacagaatatttgcgcaccttcagtgaaggcctctgtgagtggctgggcaaatataatccaagcacgtagagttcttgtggtctcaaatgatccaagaactgaatggtaaccactcaagggaatgaatggattacatgcttcctagactatcttctctaaatgtcgttttctgctttatgcctttgataggagctggataggcagtttgatatgtaaagttatgctctctgaggaagacctcaggtgcttatattccatccaatattttggaaaccagatgctgaccttatattaatatatttgctaaattctttctagtttctgaacttctttcagtcccttgaacttctcatacctctgggtctctcttcccctgggctctgcctttcataacaaaccatattccttcaaccttcacccagatcaagctaatttattgtcatcattcagattttagctagattctcatttcttctgagaaacttttcttaatcccagagtaggttagttgcttatgtagtgagctctagaaacaatactacccagtatatgttacaagttataaaactgcttatttggttatcttttttcctgctggattctaacttcctcgaagatagtctgtttatcttccccacttttacatcccagtgcctactgtagtgcctggcacttaatggctgctcaatattcatggaatgagtgagtaaaactacatagaaaacgcagaccatattcatggaatgagtgagtaaaattacatagaaaacgcagacctagtgaagttgtcttaattaattggagtgttttataaaaatcacagggatgttagatggctataaacaatcacactggaagctgcaatgatgtttacgatgtgcttcagacttgtccatgtggtaaaaatgtgtgtcatcatggtccttaactaggctaatttgccagatatctattggcttaaatctacagtttgttaaggagcatagagttgtagaggcaaaggcagcaatctagtggctccatggttttgggaaagtaaaggctacttcttttttaaaaacacagtattctgtgtctggatcccccagcagggtttgatttaagaaataaattaacgaatgatttgttaaagagataggtcctaaataggcttaagtaagtatagaaataccagatcaccgctgaaaacttcacttccttcgaagtgtttctcaaatgggttgtgaccagagagtttactgggtttcaattagaacatgacctcaagtacctggccaggctctttctagcactgtggctcagggtctgcacctattgcagtgcatttgaacttgatttaaaatcttctccatccccgattttaacatctttctgttctaagtatggcatggccacaggctgctgtatttcctgtagaagaatatcattggcttttctccccctctcttatttatttacattctgctttttatgatacaatgaggaactataaatatagaggttttttaagagcaggaactctggtaagcagattgatattttttaagaaatcagaggctgaggataaaagtctaacactctcttcctatcagttttaaataattcatttctgtgacattcagggtaccactgcagatatgctgaaactagaatgaaatttcaccttcaaatgttcccttctgcagtttttttttctttttctttcccctccaaaactacatagtggtcttaaattaaggttacttcatgttaaacatgaaagttagcctgccaataacaactaagatgtgaggagcaattgctaagcctctgttcagagctttctaatctagctcaaggctcctatcaactaaaaggtcagttctgtgtcacagctcagagggggcagtggtgggatgagagcacagaattctgcccccagactctcaccaccaccctacactggaccgcggggagtctcttctttctccctggatgttaatgatacatttcttattgctggtcggacccaaccatagaacattatttttgtgcagataacccaacttaaactcaaatttatatttagaaaatagagggctcctaatcctcagccccttcaaaaacaaaaactcaaaacaccctgtttcctccgttgtctttgcatctcaataaatgacatctctatctttctagcttatcaggctaaaatcttcggagttaatcttaacttctcattttctcagactgcacacccagttcttcaaaaaatactgttatatcttgggtctgatttcaaaacacaatctattctcattatccatggcagttatgccctataaagttgccacagacactgaattagcaaatactgaattattgtcccagaagggaattacaaggctgttgtcctgcaagcctccatcacattttgccaactaattgatacataactatgttttgtctgagtttctacagaaatataccttatttaatatatacagttgattcattaacattgaactcaggaccaactattctctgactcatgcctgaaaggtgcttgtctaacccacgtttattctatgcgaggcccatcacagttttcttatgctcaggaacagcagacagcacttcagcactctacttgagggctatttaaagcagcaaagtcacctgcaacgagcacaaaaatacgaaaagcatagcactaaatacactgtgaaagggcacttgtttacagtgtgagcagggccttgttcagccttagctggaacatgtgtgtcagacaattcagatttctcgctgctctgagcatgtctgcaactatccatgaaagcatcatgggtgttgattttgaggttacaaatcaattttagcaagcaggtgaatctgcaaatttggaatatgtgagtaacgaggacaaactgtagaattataattcccaccatttttcaccacgtctactgcatattagtttgctagggttgttgtagcaaaataccagaaactgggtagactcaacagcagaaatatactatgtcacagttctgaaggctagaagtccccaaagtgtccacaagattgattctttctgagggttctgagggaaaatctgttctgggactctcttctagcttctggtagcctcaagcagtccttggcttgttgaatgcattcttcttttgtctttgagggaggataagtaagattaggaggccctactgacttgcccccttgggaagcccggtgggcccctttctcagcaggctccacacctcttgcacccttgtgtgtcagcacctaactcttttgcaaggtaagcagtcctagaggatcccagcagactgccagattgttatacattcctaatacccagtacagcaaagagaacaaaagccccttattcctgatagagctttcccaatctccagccaatcagcactgaaagcccaggaaactattagctacaaattcctgccttgtgagagccaggggcttctctggggtcctgcatgtacacctaggctcttcaacaatttttgaagtttcatatttctataggaatttaccatttttagctaagttttcaaatgtgttagcacatagccctttgtaatctgcgccctgtccctcctgctttcctgcagctcctgcagcattgcaccattcctagccacaaccttaacagcatgcagggccccatggtctaggccccatcttgctgccttcctatctggtctccaggtttagctcatagtaacctttccctaattttaatagtaaaaagcacacccctaggtggagattttatatgctaatgatacatgcaatgtgtgttcaagcatgtagatattgagcgcattctccaactgcaggtccacctttgcatacttgacctcaccagtattttatgaatatgtccatacagctcccataaaacgaattcctcctaaggcactgctgtctctccctctgagcagcccgctctgcctcagagtatacttcggctttgcaataaacctcttcacctactcttactttggacttgctctcaaattcttttgtgtggcgaagtcaagaacatgaaccagtgcagcccattgaaaacatcttcacattatcttttctatattaaaggctctctctgtgtccaaatttcttctttttataaggacatagtcatattggattggggcctaccctaataacctcgtcttaacttcatctgcaaagactatttccaaataaggtcacgttcaccggtcctggggttataacgtcaacatcttttgggaggacacaactcaacccataatacactgctgccacctggttatgccaccatcatctcatctacattgttggaacagcttaactggtcttcctgcgtttactactggtccagtccccagaatcttcccaggacagcagctggagtgagcttttaaaactgtaagtcagatcttgtcacccctctgctccaaaacttcacagcatcccacatctcctggattaatgccaaagccattacaatagcctaccagaccccgtacaatttgcccactgcttctctaccctcgtcttctgctgcttatcttctccacatgccaccaagtttagccacaccggcttctttgctattcctagaacattcaagacatgcctgtacctaagaacatttgcatctgctatcccactacctggaagttttttccctcagatacccttatggtagcccacatacctccttcatgtcttcgctgtaatgtcaccttctcaggaaggcctttttttcttcccccaccctatttcatattgcaaccttctgcagtcctttctattccctttctctgttttatgtctttttcacagcatttatcaccctatgaaatatatatatatatatatatatatatatatatatatatatatatatatatatataatttacttgtttactgtgtttattggctgtctacctaacaagaatgcaggcttcttgggataagaatctctgtcccttctatgcagtattatattctctgtgcctagaatagtccctggcatgtactaggtattccataaatatttcttgaatgaatgactgtatgaatgacagaatgagaattatataagactggatcttattcacattgtatctccatagtctagcataggcccaggcacatatcaattatatgttttctacaacaacaacaaaaaaatgatgactgagagctggaatagtatcagatcattatgatgaaaacaaaccaatgctctcaattcaaatcacatatggaggcactgcctgttttaccagagctttgcttatatgagactcttcttcccagtaaggtggagagaatatctgggtaggactgataaagagaaaagaaaaaaaaaatgtcttatcttacatagtgagcaatgtgacttaaagttatctgattagttactgtagcacattctttccctaaaacagcattttattttttggatgggggtatatttgcagtaagttagtgccaatgaagtacagcacaaatgtcagacatctgaaaagaacgaaagatgccatgtaacctgatgggaaatgtctgctcatttctcacggcctccgttcaaagtttctcttactgttttagtttccagtcagggttctcttgtttttttcccactcataccttcatttgctgcacttggttctggcttgtctcaataaattccccaggctgaacactgagagagaaaatagctctttaaagaatgaagatatgtgaaaaaaaaatgtaaagccttgaattaaagatgtcttagttaagcattttgctaagtttctgttcagaccaaacagacaaagctgggcttatattctggtttcagaaaagtgtgtgtgtgtgcatgtgcatgtgtgtgtgcatgcgtgtaactcaggaaatagcaaatagttcgaaacacatgttagcagttaatgtgctgattatgtgtacagaaggagctaagagaatagagagagacacttgtcctctatgactttgtgttttggtcaactcaactgtactttggcctcactggactttggaagtggtaatatttccataaatattgacactacagggaaggctagaagctaaattatgtagatgcagccttacccaagtcaggctatatagggaatttgaagattaaataaaagacttagactcttgaataaaaggtattatgtaaatatgattgctatttgtactgtttcacttgcactctgaaaatatactccctcgcaactcttaatatgcagttatgtgttacaatatttattgcaaatactagcattttctagcatttttcttggtctccctctattgcaatatgcatatcctcttttctttgaaattagttacttgcctttgagggtagatttgtcttaaaggacaataattacacctgtcacataactcctcagaagaagttttgataagagcctattttccagtcctagatattcagctgggttttggtgggcattataatgattgctttaaagcaaatattgttgattattctgtttagaaaacagagttctgggctttaaaaaataacagttgcatttgtgacttacttgaaccttacagttattttcaggaccatcgtgaatacactgtccatcaagtctgcttcctaacctcagccaatgtgttcagtacctcatgatacatgttattgaccctcattttctatttgcccagtcagcaagaaatatgcactcaatcactgcattgtgaatgagtagaaaggccaaatcttctgagtctaaattgatacgaccccagtctactctctatgtattttcaagtctttgatattgtttgctaagtgtgggattcctttctatagctggagaattctggagtccttatctagaatttatctttgcagtgcagttaattaagataattatcctagttatcaattacgaaccaacctcgcctatgtaccccttcttaaaaacaaaaaaataaagagacattaaaggaaactattaaaaaaaaattagaaaaaacagcacaacattagacatgggaggtcaccagagaagataggtcatggtatatgatgtctgattctgttcatgttagacagagcccatattaagtattctcacatactgttccctttctagaccatcaattttcaaagcaaggataaaaattatagtgtaagtacaagaacttacaagcagcccaagcatatgtcacagtttctgtggcctcaatcttatggtctctacttacagaataacagttggttcacatttaaagcctattgtatcctacaacctaatttttatttataaacaccaaatgattcttttttgtacttttcctttctacagcatattgaaagcaatcattagtggatggtaggagaggaaagagatgtaacaaggcctgaatgtatttttagttggtttccaaactttgttttaagcaaatacccttagtaattaagacttttttgggctttaaggccctttgccctctggtttttgttgcctcctggtttagggagcatctcacacttgttagtatctggttgttgggccagccatgcctcctcaagatcaggagccaggccaggcaggggccatgtgtgggcatgggagagcacaaagcagttcaggagcccagagtcagctattacaggatttttgctaagttttgggctgttggcagcatcctggacctcacgcctgggcctgaatgaggccctttcttaagagtctttgcaagttcgtgttttatttatggagtgacttatcccttccattcagagcagccccacccagccatcccagcctctgggctcttacgtcttcaaagcagacccacctggttggtctccatcctgtgttgggagctcagccaccatgttcatgggtaattttcctcataaagtttatatccagttatttatataactgttatgtcaacttgtttgtattgactattttgattataaaataaaatatcttggccaggcgtggtggctcacgcctgtaatcccagcactttgggaggctgaggtgggtggatcacgaggtcaagagataaagatcagcctggccagcatgatgaaaccccgtctctactaaaaatacaaaaattagctggatgtggtggcacgcacccatagtcccagctactcaggaggctgaggcaggaaaatcgcttgaacccaggaggtggatattgcagtgagctgagatcatgccactgcactccagcctgggcaacagagtgagactccatctcagaaaaatatatatcttaacagaaaaaaaaaatcatcaaatatgtgtctactcaaagttaactaaactcaaggttaaggacacagctctccacaagattggctcaattctgacaccagctgcaaatttgggagtcctcagggccaccctcacttctgaccagctgtctacaaatttggggttttctgtgaccccttttaggtttgataatccactagaatgactcacagaactcaagaaagcactacagttatgattacagttttgctataaaaaacatatacaaattagaaccagccggaaagatagataggcagggcaagatctggcagtgttccagagcagaagcttctgatgtcctcagagacattaccctaatggcacatggctgcatgacaatatgcatagtattgacaacgagggaagtttccccaagctctagtgtccagagaggttttattggaggttcattacataggcatgactgatcgaatccttgcccaaatggttgaactcaatttccaatgcatcttctctccttggaagtggaactgatgccacctggctcaaagtcccaaccatctcatcatgtctttggtcttcctaacatggccggcttccatcctgagtcatcacattagcataaaccatcaaatatgctctatggggcccaccttgaagaacaaagacactccaatcacttgggaaactccatgggttgaaagattacctctcaagaaccagaaacaaaggtcagccaaattctttatcacacaatgtttattacacaataataaacaaattattatttatctatgaatagtaatcacataccactatgtccgtctacagtgcacattagaaaacactcacagaaaactagatgttaaaaaaaggataagttggccaggtgtggtggctcacacctgtaatcctagcattttgagaggccgaggcaggtggatcacctgaggtcaggagttcgagaccagccaggccaacatggagaaaccccgtctctactaaaaatacaaaaattagcatggtgtggtagcaggtgcctgtaatcccagctactcaggaggctgagtcagaagaattgcttgaactgggaggcagaggttgcagtgagctgagaaagcaccactgcactccatcctggacaacacagcgagactccgtctaaaaaaaaaaaaaaaggataagttaaagatagagtttttaatattgttttccagcacccttgtataaaaccagtggaaaattctccagataccccgtaaagctgacaaaaaatggtgcacaccaactgaagccatgcctacctgtctcccctggccctctcaatacttttattggcatctcactttccccttgacattccttccttcttttgcccttattggctccccaaattttgcttttcaaatcagtggcttcattgccactgaagttaaacgtagtgctaaggccagtatgacagggtcgtttttatatagccctcatcaaaacacccatgtcaaaatgttctttttttattagtaagaaatagagcaacaaatattttgacctcctattctgtccataaccttatctctgatcaaattcctctggtcagctttaggccctctctgaatttcacagtatttgatcctaatcatgacgtttttgatagatttgctgcctggtattcaaggagttaagtataataaaaactagctgtgctctccaccccaaacccagcacttcctaattgcatatcaaatatctaagcaacttgaaaacatagatgctttgttatcatttaaattatttccttatcattctgttttttataaactgtgaattttaaatatgtatatcaatatggtaatttatgtaaatctttgccttcatattttctactgtggaaatgagtgctttctgaattgacagagcagagttttacatcctatgaccctataaaatgcatcaaaaagtaccaaatatgatttcatttatgtagcagataagacagcttcttgtaggaaaaatttccttaagctgggaggaaaatttctttttttaattttttttaattccctcaatttaaagccaacaaagatagggatacgggagggaatgaaaaaggcagaaagaaaggagtgcatgttacagcagagttcttaattaaagctccattttgagaaggaaaagtggcaccaggctggggactctgagtctgatgaggagagctgagaatgctttgcctcaaagttagagaaatctgtcagacccaaatactgtgcaaccttggaaatttgacagtacttaacttttctcagccttaattgaccatcttaaaaatgagaaaagaattcctaacttacaaggtggccatgaggaaaagaggagaaaaatctaatgtacctggcatcatggggtaggcactgttttttgtttttgtttttgttttaagatactagttctcaatccagaccatatattagagtctcctggagatcttttaaaggcatatttatcttctatgccaattcagtcacaatctctgccattgtgaccccagcatcaggattttttttttattattatcatactttaagttctgggatacatgtgcagaatgtgcaggtttgttacataggtatacatgtgctatggtggtttgctgcacccatcaacccatcatctaggttttaagccctcatgcttatggtatttgtcctaatgctctccctcccccttggcccccagctcccgacaggccccagtgtgtgatgttcccctccctgtgtccgtgtgttctcatcattcaactcccacttgtgagtgagaacatgcagtatttgattgtctgttcctgtgttcatttgctgagaatgatagtttctagcttcatccatgtccctgcaaaggacacagcatcaggatttttaaaaaatctctccaagtggattgcaatgtgaggtcacattgaaaaatgagaacttttcccaaagtaattttttggtcacatattattggaattgaactttcatgtcgagtgttaataaaacattcttggaaaatacacaaatagatcttatatagcttcctaacctttcatatagctgtattttcagaactattttcttatgcccttacctctatggccaatacattaaaatttggactggatcttaatgttaattgtttaccagtgtgttttcagaaattttgtgactcagatagacacatggcatagagtctgtgtatggatcaggaattcaaactgaagtgtttgggccaaaaggattcatataacaagtcctggtcatgtacaaggacaagatctgcagtggaaccagctgctttctgaggcaggggtttgttgtagacattgtctcaagatgagaaagacagacgtcaactcatgggttgaatcaagtagtgtcccctggaagaaataacaaatgcaatgatgagaagttgtttctatcaaagatttctcatcagtgctgcctctgcaaaggttcctgggaccccttgactatcttattaatggaagtagacaaggaaggactgatagggagaaggcttctgcatgcctggggtaaatatatctgcaaacatgcagtcatcgtcacacgattcatcggcagtgtatgacatctccagctaattcagtctaggacaccttctcatgagcatgaacagcaactggagaggtcttttgaaaagaaaccgcagtgcatatgtgccccactgctggcttcatttttctctctgatgacataactgcgtagaaaagaggcaaggccatagtttctgaactttgaaagcttctgaattggcacaggggaatggtcatgtttgtggtttttcaaatattatgttttttaaaaaacatggatatgaagtccacagtatgttgaagatagcatacaaggttctgttatgtttctctggagaacaacaacaacaacaacaaaagattctattcaaccaacaagggatttgtttatttgtttgcttgcaattgaagggtttttccacggcaatcactgtgaaagacgtcaaaatgaattatatcctattctctccgatttcagtttttttcaggggaaataagacacgtagtgccctggtcaccaggccattattggggaatcaacctttgtccctaggattgcctttttggcctatctctcagtccttgcctttcctctctgccttccttgttgccaggactttcatgtcaccctctgatttttaaagcccccattccccgagaccaactgttcagaaagtagatgggggccgggcgcggtggctcacgcctgtaatccaagcactttgggaggccaagacgggtggatcacaaggtcaggagatcgagaccatcctggctaacacggtgaaaccccatctctactaaaaatacaaaaaaattagccgggcatagtggcgggtgcctgtggtcccagctacttgggaggctgaggcaggagaatggtgtgaacccgggaggcagagcttgcattgagccgattgcaccactgcactccagcctgggctgagcgagactctgcttcaaaaaaaaaaaaaaaaaaaaaaaaaaagaaagtagatggggtataataagcccaagtacctttcttcattctgacccaccagaccacaagctgttattcaaatgcatggtgctccctgatacttccattcttccatcagaacaaagggctcctttccttactgccggtctctatagtcctccttgtcccctaaagctcacctcagacacatctccttgataatgagagtaaagtcctggcggaggccagccacgaggcaggtatttattaaatgttagttatctttccttctttctgatctcctggccaggatcaattgcctcttcagggctccctcagcactgtcccttatatatcttacaagcacttattatattctaccttgtattaccaatgtttactttttcctttattgtactttgctgtaaagttcttgatagttgaatatgaaataaatttatcctcatatttcccaaggatatttcaaagaaccttatacttaggcacttaattaatattcagttgacaaatgaatgaatgaatgaggaaaatgcccaagcccaatcttatcctacataaatacccctcctacagggttttcttcttatctaaacagtcccttttagctgactgctttgatactttccagagactaatcaaattaagacaattcacagaatgtgtaagttgataatttatttgataaagtagatgggaacatttgctctttcaaaggagttttatatcctcaaagtaatctccaatttctgtaggattgatgatgaatataaacagaagggtctttttgttcctttgctgaagcaaaggaaactacctctcactccaggcaaaatcaagagcctccctgtaactagtctgtgagggagccaacattgtcctgtgcattatcaggcagtctacactttttatcacctttccaaagagctctaccagtacttggggcttcaggacaacaaagaacatcactcaggggagagagaatgggtgatatgctgaataatttgactgagaatgaggcagcagctaacggagagggtcttgcacatatatgcacacacacgtagccatccttataatattctagagaactacatgtgggagcttgagcttaacattaaggactttgatttatgacttctcattaacagccactacacatcgatgtgattcggctccatcttgcataataattaactcatccataaagtgcatgtttgacagctagactggaaagcagtatttatttcatgctactgctgcagctgcagagagaattcacatgatttttctaaaatcaatctcatgtgtatctttctgaaataggaaacagtttcacaaagttgttttgcaaatcaaatgtggtgacatattctgaaaatgtttaaagctgaaacaccttgcaaatgtaaagatatttattattttaataactactgttgatattttattgattcatatttctagataagaaaattgtttgattggttccttgagcttgatagctaagttgtccatcaggagacacatcccaaagctagctagaaggctgtggaaactaggactgaagcaacagacttttaacattcttaattattttgccagaaacttttaagttctctcattcctctcaggaattaaaacataccctgaatacagacagcttttactgatccagaaccaacaacaaaatcttctggttttttttctaacattatttctgaccaaatctctttttaatacagtttttaaacaacaataaacatagattatgataatatttgaaggatctttaatagatcttttagtaaggttgctagatatagcaaataaaactataaactgtccagttaaatgttaatttcagatgaatgatgaataaatttttggtataagtttcccatgctatatgtgggacatatactaaaaattatttatatttcatctaaaattcagatgtaatactgagtgtcctctattttatttggttatcctactttttaggatgtacgcaaccggagaatagtagaacatttgtgaaagcactcacattctaacatttctccgttaaacttccctttcacttctttctaccatctgcctctttccttttctgcaggtcacagatggtaaccaaaaacatgctattatttagtcaaaatatttattatttctggcaaaagcaagtgagcttccaaaggctgtggtgagaaactcttacaaagaaaattgcacaatatggattcattgctatctataccagggcgccaaaccacctatattattattattctttctgtctctctctctggagatatgattttatatatatatgttatatatatgtaatatattgtaaatattcagtcaatatttattttccataacagcaaggattacaattaagaccttaaaataaggggaaaaatacctggggtttaaatgattctaaacgagattttatattgcctttgcccaatccccttccttattaaataaacactttgattcttttaggcatttaaatagtacatttagagtcgtctttggggaaaagaaaaaagagtctatgctgttgctgcaggtggccatgaagagatctgctgtatgaatggcagaatgtaataataataacaaaatgtgtgtctgggaggtggagaacctttctgctatcttttttattcccatcctcaatacttgttgttcatatagtggaaatgaaagaattcttaaaaggcacataagccattccacattacccagaaagaatttcaaggggggggaaatgatctatcaatctagagaaaatacaggcaaaacacaagaacaagagagataacttaccctttaaagcttaaaactgtgcgtattttctcattgtgtttatccttgatattttaattatgtacctgcctttgtgtctttctttccactaggctgaaaattctcatgaggtcataagaaccttggctcatttttgtttgttgctattgtctagcatattccctgattcattgtgcatgcagtaattatctcaaaaagtctgagaaccattgctgtaaaatagaatataattgaattgggagataaaactactcaactctttaatctggggaagaatcatacctctaatttcattggcttgcttgtagctccaaccttatatttcttgaagtcccatgggtgtgtgtgtgtgtgtgcatgcatgtatgtacatgcgtatctcccttccagaaatgaaatatatacatatgaaataatatgtcctagatattcctttaggaagaatttagaacaaagtataggaaatcattatgaggtagagatgtctaactgtccatcaagtttatgctccttcttctataacatagttactgggaagtggttgcagtcagtggctacatttctcagcttctcttgcacataggtaggccatgggattagttctcaccaacaatgccagccaaagtaagtatgccattatttccagaccatggcagttaagaagtgaatttgctttctccatccctgttttcctctttaatgagcttggtgcagaatgaggccatatagtaaagacagtagagccagaaaattgaaaaaaaccttgagttctagaatcacccctgaaaagagagcctcccccaatgccatcaaacataaacattaatttgggacactatgtacacaaggagtaaacttctatcatgcccttactcctaatatattttatgagtagaattgtactttgcacctattcccttttcttctattgtctaatctccagaagcagtagtttagactatgtattcttatagtctgcccttcaccatctttctttcatagtgtttagaaaagtcctaatattaagaaattgtgatttttaaaaaaatttcaatgtggttggttctgtgtgaattttattttcacttaacatttatctaatatccattatgtggagcacacattctgctaggccttgggaatgaaaattgattagctgatgaattcacaaaagaaaaagacatataaaggataaattacaagagaatgcaataaaaatgttaacaatatgaatatgtctgtaggagcaaggagagaatattgttgtctttacttgaagcagaagataaagccttcacagggaaggtgacattgagttaggtcttacaggataaatatggggtttgtcaaaggatatgaataactgtttacaatttttaaatatttgtacaaagaagatagaatattacttttaatataaatgtaatggtttgtcatattaaaatttgtcatattcatcaaaataactttccattgtttcagccttttgctgaataaagttttcagttattaactttgttattaatttttttgtttcaataaccatgctttagccttgcagctattttagtaaaacaaacaacaacaacaaaacatgatctaaatcacatcctaatttttattaagtttgagaatgtttttgaaaaatcattctttagtctatccagaatttatggttgtatgtgattacaaataaaccagtatttatttagagcatgagatgtcattcattattaatttatgtgttagccatttcttttttatctattattctatttcatactgtattataatttattaaatgtatagtatatttgttttcatcattctagtcttctatttttaacctgtatcaaacaattttgaaactagtgttttataatatattttgctatattacagggcaatctccttagtcttagtcttccctctgactcttctcaactaatacagtgttcactttggcaagggaccaattctcaacagccagaagtttaaaaacaaataaaataaacaagaaggatttgagaggttttaaaaataagacaatagtaagatatatggttggtacttcttatttgctattgtgagtgcttcaagggcagctatctcatttttcttcttaattctctttaagattttggaaaataaatgcatgatatatgtgttgaattgaatcattgcctggccttggcccatttctttgagtggcagtaactctgcttaagaatcagctgaggaagagttgcattcagccactgtttaaaatagatatagaaactctaagaaatagtcattagaaaacattgaaactcttagattgataaggttttgaaatagaagaaaagaaattaggtctctgactctcttgaaaactattgagtataagatttcactctagattctttctatatatgtagaaatgattcccctagtcaatagagttgtattaatcagattgcaaatgtttcactttttaccttatgttgtttattgtaattcatttcttcattttaaaagaaggatgtgccatcatgtattttctttccttccttccttccttgcttccttccttcctccctccctcatttccttccttccttccttttattcattttgagatggagccttgctctgttagccaggctggaatgcagtggcgtgatcttgggtctctgcaacctccacctcccgggttcaagagattctcatgccgcagcctccagagtagctgggactacaggtgcccgtcaccacacccagctaatttttgtattttagtggagacggagtttcaccacgttggccaggctggtctcgaactccaggcctcaagtgatccactcggctcagcctcccaaagtgctgggattacaggcatgagccaccgtgcccggacccgtcatatattattcttgaccatttactctgtttttacatctgctactacaaccatgcataaccaagaaaaaataaagatttgaatcatagttatcgcagttgagacagaaatccaaaggtagaattgagaagtattgtttttgttcactgccatgtctccagtaccagagcagtgcttgatgacacatagtaggcacttagtaaacatttgtcaagtgatcgaagttgagtcaagcatgagtcacagccagcagagcagctcactgaggagcaatcatgggtctaagtcagggaggctgagaggaagtcagaaagcagattatagatagattagggtcaaaggcttggacggaagccatgaacatgatatgtgaaggagagggagatagactccttggctttataaagactggcaggataacatctgcacattggatacaaagaatatttgtgatttctattgtcatatggctaaagtccattttttgaaagtacattgacatcataaaataactgtttagtggtaacgacttctagtcatgttagtcatattacttgaatgaagagtatattttgactgagctgactttttatttgataaaatatttcactgtttttcagaatgctgaattaaatctgctgtttcagtagttttaaataaagttgtgaattaatgacttaaatgtaggtcagagaattgttgattttccttcatttgaagcctctcaaacactgcctttaaagctatacataaaaaagcaagggcagagttcagcccaatacagaatgcaagtggatacagaaatcaacttttcagactcagtaggatttttttctgacttggggagataaatgaatatagaattccagacttgcctaaactgttaacaaaattattacagagatgcaaaaaaaaattattctttaacttatactatggcacataagctaaattcaagataactacatactgaaatcacttcttgaaactatttagtaattttcaatttcctgaactctgtaactatttggcaacaaatctgttgactaagcagtatcccctaccagaagaaatattggccctaattcacaaaatactacttctataatttaatgatagaactgcaattcagtgcttggaaaagaccaagctatcagcccctaattatatataagggatttaggaatacagccaaccatgaaaactcccagcaagactgtgtcccaaaggaacatccttgaaaacaaattctaggattgctttgggcagaatagattaagaactacagtacggaaagcttattgagtcaatgacagaaaaaaaaaaaaatctgcaaagagaaagacatattccgtgttaaacatttgaataagttcatcttgaactctttagggttcaaggttttgtggtgtattatcagtgatttgagtcaatggaaattcttaatagttggcctttttgcttgattaaaaatgacaatctgattgctgatggactttctccagctattaagtgaagtaccaaataaatagatattgcaactttgggggaattatagagatctgaatttcctttactttgctcaattttattacttttcatctactacctaaaatgcagattttttcatcagtttaaaatagagtatgctatttgaataatgtaatcatatgctagcttgcctaaaggattaaattatggaaattcactcccaatctcaaaatagttattgatgatctaactacttgtaatgaattaggcttatgactgctttatgacagttggaatgagagccattctttcaggatcccaggcagggtcaattttagcagagaccttaaagaatgaaaaggaattattaaaaaaaaaaatctacattgctatcagaaaaatggttaataggatgttttgagcctgtttaaacttcctccaagattcataaatattcattgaatcaattagttatttgaagcttaatgttttgctgctgaatgaaaataattatctgctaaggtgggtgtcctgtctggagcctgcatttatttttaaatgtgtcgaggaaattaatggggattatcagcttgatctttctctatgtagaggcattatttagctgaattaactttctctgaccccccaaaaccaagagatctcaatgagatatatgctgtttccttattcccaaatcatagatcttaagaagcagttatttcttaaaagtaaattttaagaaatgccaagtaaatccccctcatttataaatacataagtaacccctcagttatccagaatctggacttctaaaacttccagtttccctgaacttgatcgagaagtaatcctgcaccataatctacctccctcaattatagtagtctttcgagtcaaaaagaaactccggagcatctggaaaggtcagcgttaaggaggaggagaggccaactggaaagaaatgcttgcagttagttgcacagctgtcttcacaggaagaggagggaaaggagagcccccacctaccagccctgtccatgaaagatacaaaggcaagtagcatgggagaagttacaagagacaagaacagaaccaagggaatggcagacaagcagcagttctataggctggtggtgtctgggatgaaatggctgtctcagggcagacgggacagttgtatacaaggagacctggaggcaagaaccatttaggctgcagtgggacccttgccttctaatgtctccaaacagtagccctttaaatattgcaacttgtaaaggtttaattttctgtgttgaggggaagggaagaataattgcttgccaacattagtgggccaagacgtgtcagatgctgctttcagcttggggtcggggggttggaagtcggagacagcaataggtggaagtgggagattcttctatttgagaggggagagaagtgtacatacattttagaaagctttccatcacaaaagggttaaattttggcacttacagggttagccctcatttctgttatgtgaagtgaactgtataattcactgtctctctccctggttgagacttgtgctttacaacacaattattatactgcctatgtcattaacaaaggtcttgtggaaactgtcactaaataatgtatgtaaccaaaacaatataatgattgtggtctggatatcattgtcggaagggcacgctccttactttgggggctgagtcttgtttttgtttctagttcagcctttcctaacccaggtagcttgcatatattaggcattaggtaaatgcttgccaaaatgaaaagaggtcaaggtcagcgtcatactcagcgtgaatatggatacagcccagggccagtttagtaaggaggacaggaagagaggtaacttttgcctttgggaggcaacatccactccccaacacactgaaagtgcgaattacccagttacccagttaccgcagaccaagtatagacaggacaaaaactcatacaactataccagccacaaagaaccacagcaccaaagaggaaccacaaacaaatgtttatatcgtgcgcaatctcttcatactttatgctttcttgaaataaagaaaactgaggcacaaaaaagagtaacaaattgtatttgcacacagcatcctatctaccatttattaactgcaaacgcccttgtgaccacctccacggcttcagcatcgtccagagagctacatctaaatctccttattctccttttttttttcttctgcacaaatcaataaagccttttctgtcagccccaggtaaattccaattccaagcaacttgggcaaggaaacaaacaagtgaaaaaaaaaatcacattggctttaagatgctaaatttaagacatgcagttggagctgacagctgacaggttatcaaccagaaatcattctctgatcacttattcaacaactccaaaagaattgcagccacatgaggcttgtaacgaagagggctgtatttccaaggaggataacagaagggcacatgtggaatgtggataatttccagaagatactgagagacagtgctggtttctgacttcttattctagggcaatgccttttgatgtcctgattcaatgccgttgtaagcctgaactaatctgatgtaataaaagcttaattgtctacttgcaattatcatttccctttaatctggtgatctgtttttatttgacatagattgctgttctttagagtgggatacactttgtgtaatgtgtattgtgaaatggtgttcatattttgggtaccattataaactgtaagtcacgcctgataatctcatgtctgaatactgaagtgagtgtacctccataggctactgcaagagagtactaggggctagacaagactacacatcaggactcggggcaggcaggaccaggcaagggtggctgatggcatctgcaagactgcagcactggaggaggggaatggctgctgccagggcttgtactgcggaaagaaacctgtttctccttaatgatggtgttgtccaggcaggggcaggtcagagtctctctcattctaaaaatgcccactgggcagcattttggatcccaaagaactggtaagtgtggggactgctgagtactaggcaatagtttgcaaacttttacattatcactgactttattctactctcacctttgaatttaaaccaatttttaagtatgcaaaagaagacagtttaaaaaaatttccatgcaaattaacatcacattcttaaacagatgaaatattaaaactcatacaagtatttttaatgaaataatttttatttgctgtgattatacatattgacatttgcacactttttaaaactttttatttggaaaaaatttaaattttatagataagttgcaaatataaaaagagtgtaaagaatacccatacacccttttcccagaaagacttattgttagcatttcacacaattggctttttggtttatttctttccccacccacctcaccccatggttctctctctccatacatgttacatacacataattatatacttaatttttttcttaataaattgaaggtgtcacatacatgatggccctttacgccaaacatcagtgcatatttcctaagaatgtagatattctcttacttagccccagtagttatatatatatatatataacatatatatgttatatatatatataacatatatatataactactatataacatatatatatatatatatgtatgttaattttactttaagttctggggtacatgtgcagaacgtgcaggtttgttgcatagctatacgtgtgccatgatggtttgctccacctattaacccatcaactaagttccctcccctggccccccaccccccaacaggcactggtgtgttgttcccctccctgtgtccatgtgttctcattgttcaactcccacttatgagtgagaacatcatattttgggtaccattataaactgtaagtcacgcctgataatctcatgtctgaatacccaaatatgtgatgtttggttttctgttcctgtgttagcttgctgaggatgatggcttccagcttctccatgttcctgcaaaggacatgatctcattcctttttatggctgcacagtattccatggtgtatatttgcaacattttctttatccagtttatcattgatgggcatttgggttggctccatgtctttgctattgtaaatagtcctgcaataaacatatgtgtgcatgtgtctttatagtagagtgatttgtaatcctttgggtatatacccagtaatgggattgctgggtcagatggtatttctgattctagatccttgaggaatcaccacactgtcttcagcaatggttgaactaatttacactcccaccaacagtgtaaaagtgttcctgtttctccaccacctcaccagcatctattgtttcttgactttttaataatcgccattctgactggcatgaaatggtatctcattgtggttttgatttgcatttctccaacttcaatatatttaacattgatagaatacttttttcttatctacctttcatacatcagtattgtcatttgatccagtaatgttctttatagcattttcctctgtggtacaggatccagtctgtcatcaggtatagcatttaagtgccatgtctctttacccactttcaatagggaatacttctacaacctttctttttattttctgacattgacttttttttctgacattgacattttggaagaatggattactgccacacccgcccccaacttttttttaatgaaacatttcccgtttggggttttttagatagcctttcgtgatcactttcaagttatgcattcttctttggaatgttgcataggagatgttgtgtccttctcaggctatcacatctgaaagcacatcacgtccatctgtccttcattggtgatgttaactttaatcagccatacaagtgttttctgatttccctactaggtaattattgtataatttttttcccctgcaactaataaatagtctgaaagagacagtttaaaacatgctagtatctagtttctcatcaagatttccctctagatttagcatccattgatgaatcttgcctgatctgatctttaataaaacagttgcaatattatgatgttccagtgtcagcactctcttcacatctgccatcagctctcagaattctacttcaagcaaaagctcccctacttatttgtttttgttgttgttgttgttttgttttgttttgttttgtttttgagacggagtctcgctctgtcgcccaggctggagtgcagtggtgcgatctcagctcactgcaagctccacctcccgggttcacgccattctcctgcctcagcctcccaagtagctgggactacaggtgcccaccaccacgcccggctaattttttgtattttttttagtagagatggggtttcactgtgttagtcaggatggtcttgatctcctgaccttgtgatccgcctgcctcagcctcccgaagtgctgggattacagacgtgagccacggtgcccggcctttatttgtttattattgatatagacctataaattttttccaatagtttataattggaaataaaattttaattaaatggtttatttactcatttatttagtgaatatttattgaatacttacaatatgccacatactctattctggtgatacaactgtgggcaaaacagatgtaacctgtttttcctcatatatatagacatattgtttatgtgttatgtacagagatttgaggactagagtctaaaagaatattttttaatacgcatgttaaacccttaattcatttcttcaatagatctgtcaaacactggtgtgttgagaaccgttctggaaactgagagcacaaacagggtccctatccttagggaatttgcaatcaaatggggaagataataaagaaataaatacactatcagaagaattgcaggttttgaaaggtgttttaaaaggaaaaaagtaaacataaacaccagagctaagataaaggatgacgaccaaagtaacatagaggccagtgattactaaagtaaaatgaaatctggaaggatcacttcatcgtgatctctcatgaatgtttgagtggtgcttcactgggtaaatgttccttggacttttttttttttggatacttttccatggtccttgaccagttggtttccagcagcctcataactaggcacatgtctgctgttgccacctgcatggatccagcctttagatttgacatttccaaaccagtgaccacctatcagtaacttctgcaccaggatacaaatgataacatagccaaatcaaaccgctttatactaaatattacctccctccaacattcaacaaatatttcataaaaatgcactgtgtcccaggacactggaatacctgtcattggaatgtacatttcagtgaaggatacaaacaagtaattaggcaagatactgtagtcagtgtaatcacagtggttagtacagggtcctgagggagattatagaaggagtttctaacccagatgtggtggggttggggcaagtggacagaaagcctttctggagttgcagctgatacttaaagagaaatgtaagttagccagagaccccaagctgttccctgcatccaggtgcatgcaataggtgcaacgtcacaaggaagttaggcacatatacctggatcccctagttcaccactgtctgcctccccagtgtctggcacataatttacactcagtgaatattttggaacaagtgagtaggtacatgccaaagagacattttgtcctcggaagagaagataaccatgataaaatttaatatcaaattctttataacatgtaatgtatgagattatttctgtcctatcaagtttgcattcatactgtagctttaattacatattagaaaggaggatggagtggttttcgaatctgctagtattaaaacatttttgctgatgcctttaactagatgagttgtaaagcacattatttatacctggaagaactggcttctcttacccatttaatttttccaattaactgaaagccaggttgacttggctttggttcactctgtggtcaaaatttagcatcatgggtattgattaattagtgatgagtcatttggcctataagagcataaactacctgatggcaaatttacaggacgaaaattaggccacagagtaagtgttgttcttcgttactaaaaatgaaactaaaaatgtcactgccgaagtggaactaacaggagcaacagagagaatcaagccaagtgttctttccttcctctcctgtctccctgacctagataagaaaccttacccaatcctaactcctagttccgtccacccttatttgagaccctcccactaagggaccattgccattcactagatcatgatgggtatgacccagtgaatggcaacataatgcataggataaatgtgcaatggattttttttttgtccatcagatttgggtgtttgtttgtatgaaaaatttagcctcttacttgttgtctaccatgaccatatagaaaagtcatgaaagttttggaatatgagctcccggatggaatgtgagaatatgagttctgaagttagatgcctgcattcatttcccaacaccactacttaatgatttggatgcatcagattcttcactgtaaaatgggaagtttaaaagtgcctacaccataggattgttgtgagaattaagcaagcccatctatgtaaaggacttagcatggcggctcactgtaagcctcatttaggcatcatgatgctcaaaaaagggatcaccaaaacacttaactgaatatcaccccaaaatcaagtgccaattcatgtaagcagttggtattaaacaactagtctgttctttcttcttgtctgatgtttaggacctagaatatcttatatgatcagctaatgtactctgataaaaatgaaaaatactgattattgagaaagtgtttttgagagcccatgatggtcagatctctgtgctaaatgctatggtgcacttgaaaacaacttcatttctgcctccaaggaacttacagtctagttaatggagacatgtcaggaacacgtgtgtctaaaaacatcagtcatcagtacaggaggtcaaatgattagcactgtaggcagtggagtctatttgctgatggcaagacttccagttaaatagataacgagcatcacttaaacattttaatttcccaaaggaagacaatatttgtgcattttaaatgcagtttatagaacatgagttatatatgatcacattccttctctctctctctctctccctctctctctctctcacacacacacacacacacacacacagcacaaaccatttagaagaccatataccacattgtttactgtggatatctctgacaaaagcattggaactgcaaatggaaggctacttttcacattttattcttcagtcttttgtattgattgaatttttttacaattaaatcagaaaaaacaatggaattatttattttagtaaaatatattgaagataattccctgagaaagctaaattcatcttctattaatgactttttacctgatagttatataatgtgttctttctttacaaataaaaattatacaattaataaaagtaagcatttgctatcccacaaatattttttaaatttaatttgggggtaacaaacattttaaatacattatgttactggttctgaaaaatctaggtcaacttctaggatcttgtttgatgtaagaatttgaactgtttccaaggtaaccaatcatatctctagaaagcttagctaagcttgtatctcttcattttgaatgctcagctctttttatgtcctcctggaaaccctgaactttgacatacacacacatacccacacacatgtacacactcactccagactttgcttgccttccatcagggacacaaggtacaacaaaaccaaataaatgctcattgatttttaagttgtttaatgcagctgtttcattatcttttctgtctttatatactgtaagtgatgacagtcaaatgttgtgtgactattcataaaagaaagcatattaattttgtatgaattcccaggtacctgctcttcaatttatgatcattcttttctctttattttatttttctctagcatagatatgaagcccaagaatatgtcaataatgtttagtaaaataatattaaattttttcacttaatttgctagtatggcattgactaatagaaacatcatctgagccacatatgttatttttggttccctagcagccacttttagaagcaaaaaaaaaaaaaataggtaaaattaaatgtattttatttaactcagtttatctaaaaagctatcatttcaacatataatcaatataaaaattaatgagctacttttttgtactaagtcttcaatatctggtgtgtactttatatgtgcagcacattgcaatttggacaaatcatggtgcaaacccttaggagccatgagtggctgaaggtgaccatattggacagtgaagatctagacaatggttgttacttcctgttagtatcatctcgtcagtgggatatttaaagacgtagtgtattattttgcaggattttcttttcttcctgaaatttaattaataacatattaaattgggcctggtgctgtggctcacacctgtaatcccagcattctgggaggccgaggcaagtggatcacctgaggtcaggagttcaaaactagcctggccaacatggagaaaccccatctctactaaaaatacaaaaattagctgggcgtcgtggctggtgcctgtaatcccagctacttgggaagctgaggcagaagaatcctttgaacctgggaggcagaggttacagtgagctgacagcgccattgccctccagcctgggcgacaagagtgaaactccgtctcaaaaatataaataaataacttattaaattgacttgcttaattgaaaatattttattttcacttttcataggtgtccatttatcctttttacagagttttcctactaataactagccatctgaggaaactacaatatgttttttactcaatatttcctaaaagataattttcggaaaaaggtaaaatcatgactctcatacaaatataaaatgaatatatgttacagaattttctttactcgtgatatgagagaactaggtagctgttataaccggttcaaaagaaaagtcaaaacagtataaatttacatggagtagagcaatgttgagatgaattccaaatgggaacaaaacttttttctacaagagggaaaaagtaaattaaattacaaccaggtaaggcagaacttacagagctaccagttacctacaacttacaatgaattacaaaatagctcaaaaacagtgagtagagctagaatcctataatccaaaagggtatactatatatgatgcatggttttccattggaacacaaaatattttgtacataatctgataatcaatttagagccatataagcatctagtttaagctttgtcccagaattttagagtaatcatgggcaggtcagagagattatgcttcatgtctgctgataaaccaaggagtggtattacatgttctctaagcttctttccagtaatatgactttttaaaaggaagatctccaaaaatgctttttatctgaacacttttccccatggatatacagagagtaagcagagaaggtcccattcagaaatcagtctccctacactgagtgagtagatctggttcttctgaggcagtctcctcacctgctgatgatgtcatcaaatgcacattataaaagtttgcatgttgtcaaaaggaaacaggatgaccaagttctcacacatcctagtgcttaccactctttccactcccagaaaagaagcagttcccccttccctggtttgcaagatagatatataataaaatttgccttccccacaacttagaaaagaaaagcatggtgatttagagtaagaaagttatttactttcactctagcaaagcagaaaaggtaatagagtgatatggatattataacacagagagaatggctgatggcatcataataggatgcactggactattgagaaattccttgcaggagagggtgatatatagaagggcaatggattagaagtcaggatctcagggtctgcacccacttctgggaagcctttcaacttgtcctaaatgaaggttatcatgttcttctcattgaataaggtttacttttaattattttctttaaaaaatagaagaaaaacattcaggtagcataaaacaagcctaatttggtatcatatatcaaattttgatatctttttgtggaactcaacacacgaatctgtgctgtaaggatgcagaagtacagtatcaaacttcagagagggggacaatttcagttactcttttatcctgaggtctacatgcgtcacctttgtgtaaatttaaaaagactaacctgagcatgtttcttaatctagcctccattccttgtgcccacggctatggcctttaaatcctaatgcatgacgatgtactcagctgggccaagacatttagaaagcagtatgaacagtgctttgttctagaggcaaggaacccacatgatcacttgtgcaattcccagtcctctgtttgggaggtaactactggaagccacctgaggactttctttcttcagaatgagtggttctgactcactgagagacacttcactgccagtccacaagccattttcaattaagcaaataatgtagtatccagaatactctctaacatttaatgttgaagattcacttagactaggaaaatcttcagttaaaaggcagaaacttctcactttaaatgagcataaaatttagtttgtcaattttgatagcactcactataaaatagcagttctattggactgctctcttggttaaaaaaaaatctgccgataataacttggcacatttgagctatttttgcttccacacctgaggcgagtagcttatatctgaagccatcaatttgtatactttcacgaagaactgaactattttcatgaactggttacatcaatgatctttattctcataataccacctcctgttatctattatgatctttcttataacagaaggaaacattaaggagaatactggccttaagacttttttttgcatgcatatgatagttattattttcaggcacttgcttttttaaaagactgatgtatttgtgaaatatatcttaatattctattgtctttcttcaaaactgtcaagaaaatcaactagaaagcaggaaacttcttacaaaaaattaaaaatagaaacagaatcagatcgaacaactgaggatcatgcattgcttgggaaaagtaaggttaataattaatatacccctaactttctagccagcacctcctgctcccaaggtgaggacaggcccagagtcccattgtgcctttggtagtctaaatcaattaaaaattgagctatgactggcccagttttttccattttcacctccctcagcttacattttcttttgacttgctttatgacagataagagaagaaacagtcatgtaatgagtccttaccacaagacttatctttcttttctctatttaattctgttgcctatttatgaaaataaaactcgctcattttagaaatgtaacaaacgcatcatgtgtaaagaggaaagtccaaatactcctaatctaaccaccatcaatatttgctgtgcaaccttccactcctctttttataagtaaatatataatcacatgtgaatggaatcatattaagcatattgttttgtaaccttatattgttatgaaagttatatcatggaaatgtttccatgtcaatatagtcatacatcatccttttaatggacataaaatattccactgtgtggatgcatcatccatcatttatctaatccgtcacattgatatatgatatcaagacataatatggtgatatggtttggatttgtgtccccgcccaaatttcatgtcaaattataatccccagagttacaggaggggcctggtgggaggtgattggatcatgggggcagatttcctcttgctgttctcatgagagcgagtgagttctcgtgagatctggttgtttaaaagtgtgtagcacctccccctgcccactcttcttcctcctgctccggccacgtaagatgtgcctccttccttttcaccttctgccataattatgcatttcctccgcatgatgctccccagccatgcttgctgtatggcttgtggaactgtgagtcaattaaacctctttacaaattacccagtttcaggtaattcttttttttttttttttgagatgtagtctcgctctgtcacccaggctggagtgcagtggcacgatctcacctcactgcaacctccacctcccagctttaagcaattctctgcctcagcctccagagtagctgggattacaggcgtgtgccaccacattcagctaattttttgtatttttagtagagatggggtttcaccatcttggccaagctgttcttgaactcctgacctcgtgatccacccacctcggccccccaaagtgctgggattacaggcatgagccaccgcacctagccgagtagttctttgtagcaatgtgagaacagattaatacatacggaaataaagtccagaaataaggctgtatgtccacgacagaagttcagagacaaagctgcctcgtagcacctgaaatttcttgaaatttgagaaagaataattaagccctttcaagtcagcaaatggccaaatgaggaggtgaaatcaccagaggtcctggtgtttctagaagatggggtgtattgccaccatgactatgttagtgaagctcaggtgtgaccagaggtcgctggtggggttcagagtctggtaggtagatagagctcagctaaaggtttaatcggagccttcgttagataaaggcatggtgcaggggcacaaaggcacaagaaatacctgttagggtttagagagtaacacaggctagcatgtagaatctgatataccaaagccaccccagccaggagacatctggcagaagctgattccaaacatacaggtgaggagtctaagtaccacgaagttagaggaaagaagtgagaaatagacttcaagagactgagaacagcatctctgaatctaaagcacaagtgtatacccacatagtcatatagccagcgggggggactcagacaggggctgtcaaacctctgccgtgaaaatcatcaccctgtggacagatcagtgccagtacatgtggtctggcacccagggaaagcaaaattctgctggtgctgttaatttcagacaaaaactgagttatctgtggagtcttcacagtttctacaacaggccaacactttgtaaagagggtaagcagttttctagtgagttgaagtgatgcaggcagccaaacctcagaaatttggccaaagtaattcacttgataattctcagctctgaaaggtgggctgaaaacaggcactctagttttcttccattatgcatttctggcagccacccagccaccagattcttagctttattctacacactcatttcattcattcattctttgaataaatatttattgagcacctgctctgtgtcagatactctgctgtgtactgcagagggttaaataaatcacagtccttgctgaattcaaaaagaagagaaataatactgtaccataaatgcaagaaaaagaggctgcagaggtatttggggtaaaagataaacatttcctctttttttggcaaagattcacctcattttacaaatcagttgaagacttggtgaggagagataagcattcttctgatattgctactagcattcgttaggtactcagtggattggaagcactaagctagacaacggtcatattcatattcaccaaatatttactaatcacctactattatgtcacgcattgttctaggctcaggggataaaatagagaacacgagagacatggaggcttatagcctactagtaggaaaagagaataggcaagaaaaatatgggtgataagagctatgcagaaaattaaaatgataatgatgtgatagagtgtccaagaggcagctgtagattaagtggtcatgatggcctctctgacatctaaactgaactctaaagggtgagaaaaagccagcccctgacacagtggagtccagctcacatttgtataagacttccaaggctaggccatatgtagtgaacctccagaacagcaagaagaggaatggggctggagtagaagggtggaagaagacaggtcagagtggaaggcagagacctgtcttgaacatgctgactttgaaatgcctacaggatcatgcagcaccaagctagagaatgggcagggagcatcctcaatcacctaggtgctcaaaacaaaagaagtgactcttgatcccagcactgctttcccccatagcaatcacaatggcaccactgagaaaagttaaaatcctgctttgaagcttattttataaatttctttgccatatttcttatgtagttgagtggatcagttaatcactcatttaacaaatattgttgagtgcctaatacgtaccagccacaaacaggtgtagctgggaggcagacaacaaataagaagggtacaaacaacagataaaatatgcagtatcagatggtgatatgtgctttgaagaaaataaggctgaataaaggagtacagcccaaggactattttagatcagggatctgggaagtgacacttgagcagagacctgaatgatgagaaggagggtgccatatgaaagaggggatcatatgaagattatgggagatgggaggagcatctcaggtgaagggaacagcaagaactgccccagaagcttgctgagtccaagcagcagcaaaaaggccagagtggctggaacacagtaagtaagggtgtaaatgtcagaggtaaccagggctagatcatggggtccctttgagccacggctattctgtgtgtgatgggaagctcaaggagtgtcatattttaatacttgcatttcaataaattcactcccactgctatgtggagattagatggggaatctaagaaagaaaagctggaaaccaactaagaggctgcgacttgaacctacacaagatgtggtgatggtagctggcccaaagcagcagccttggaagaagggagaagtggtcagaatcaggctacatattgaaagtaaactgggcagggtttgatgacaggggagaccaagaagaaccgaggatggccgttagttttgggccctgagcttctcggtagatgatggcagcagtaactgagggaggagcagctttggatggcaggaagagtccaggggtgaaggtagagatagcagtgtgcagggtatatcctggacagctcacatttgaaatttccattggatgtccaagcagatatttgagttggcagttagatatttgagtatgtagttcaggaaagagagagagttaaagataggatgcaaggagtcattggcattaaagtattaaagtatgtgtacattggtgcttccttcttagcatagacttgggtaatggggcagtgtgcactgaacatgtgtttgttctttccttatgttatgtccttctctgggacagtagatgatactgggaacgttacatctgcttgaaaaaataaagagaatcctgacaaccatatctttaacaaaagaatagaagcactgacagagtttgacttgatctgaggaaagttctgaaattctgacagtcttttagtgtataattttattagatttggacttttcatgtctttctgattttatgaacctgctattcaactgcatcctcatatataactgctaccaggaggtgaaatagtttatgcatgtttctttaagagaaatgtaatcatctgcaagattcttcaagatataaatttacatttaatattctacaccagggaatattggcaatatacagtattttgatcagattctttctgataaaatatgaagctctgaagagtgttactgaaaaacagtaactaagtcacatgcgaaaacgttcctaaaccttaaaatcacattccatgggaataaatctagttgcatctggtttagaaaagtgtagtccagacaatggtgctgcaatccattccatcatgatcattgtaattatctttgctgggttgtttctatgtaatttaattattcacttcaatacagaatagtattattaaagaataaggagggtaattattaatatgttctgccccagggtgagagtaggatgcttaattaatgaaccaccctctttcttactttatgaatggctcagtgatgttgcagtacagcaggttgttaggtattctctcctgctaatgggttatccacatcattttctcaactagagtagaaaaggagttactatctataacccagaaatgatattggcagagaaactgaataatcactgaaacagcttgaaatagtgttcattctggacgactgacaaaatgcaacggggaaatatggtttttcaggcttgatgcaagcctgagtccagttcgggttttccttgagatggcctacctcttcccctcagatgcttcttatctttgagagtttctaaaagataaacttccaagaacctgttataagaaaatgtctctaatgtctagcatcttgttatagtttggtctaatttttcccctctatgtttcttatttttgagagtttctaaaatataaacttccctgaacttgttataagaaaatatgtttaataaatggcatcttgttatactttgccttctttaaaaaccttgggatctctttaaacctaaaacaggaagtgaaatttgaagggctaacatgaattttaccaaacaacacagtctgggccaataattaatattaattatcataattagtcataatcttttttactttacatgtgttattttataccttcttatttacataaaattcacaggaaacaggacaaaactcaataggaagagattggattctgaaacacacactcatatatactcacacacgtaaaaacatgtacattacagaatacttaataaatttacacttttgaattaaataagaatggtttaaaaatatttaaagaatacttcaagtgtttcagaaaagactaagaatgcttcactatatttgtaatttggcccatagagcaataaatgtttccctattatatctgaacatatagaggccaaacgcccaactttagcatcaccagctcctgctctaccaagatcaattagacaatgaacaaatgtctttagaagtaggaaaaccatgagtaagctacctaaaattttacttagcaattgcttgttggagaagggacaatgctagataccagatgaataattatgatgaagaatatgaataaataatttatataaatatgggtatacatatgtaagaagtcctgctttaaaagagattctgttttgtcaaggaataagtatttagctaaatactagtaatttaaatgagattaaaaaaacctctttaaactcttagttaacataaagaatccatcaaaatcatgggcttattgtactttaatgcatgaaaggaaaaatggaaaattcaagaagcttgttttctaggttgcttaaaaaactcacatatatttataaattttgtattatttagcaacaaattaataggcaagagaagcaattagacatttaaagtttcagaagttaaaagttaaaatttttaggacatagcaataattttcagagtctaggtattgtcaataacttttttgtaacagttgcaaggacaagttttaaagtagcagaaatcagaaaagaatggttatagttacacaagtctccagagttaagatctagactgttgtgaatgtctcaagttcaaaatttttctttacaaaataaaatctgaatatctgtttttgcagaagtgaaaacatctttttttttctttcttttttctttttctttttctttttttttttttgagattctttttcctggcagaggttaatggcaaagtccacctctcaaggctaagcactacaatctcatttgttagcaccaagagataagagaaggcttggtaaactcaaagtgtataaaatggaaatagaaaagagcaacgttgaaatactactgagtaaagcagaaatatgctaggtggttgcactggtaactcccaataaaagcacacctctaggtatccatacacttctatagtcctctcaagctgactctgggcttggctatatgaaatgcatgggctaatgcgacatggatgtgagcagaggcttgataagtgcagtcttgaatggcagaaccaggagaattgactgtacttggttaacaatagggaactagtgaaggtttttcagcaagggactgacaggaccaatgtagtgcttcaagactatgaacctgatgatggtattaaaataaagtcacatgggatggggtgtttggagatcctggtagggtgaacatttgtgagattattgttctttaagtgagtctctccattagaatagaagggcagaaaatcaatactggaaatagtctgtgtgttaagaaaggacttcagggaagaaagactaatgcaccacagtgatgcagcagctctctcagaccactatggacagaggtggacagccttagccaagtccctggagaatgttctccaaggttgaataaatcttttcattgtcatgagaacaaagaagacgagagagaaggctcatcgtgcttgtcttttgatttttatcttatttctgggcatcccatgaaagcacacttcaacttatttccttgaattctaaatttctaactattccagatgactgcatttcagcataataatctaaatctttgcattcttctaattttcagcattcatatgccaaaaatcttaaattgcttaaagattatatatcaggtaaggaaattataggtctattgtatagagaatcataagagtggagaagtaaaatctttttcagtaacaaagaaaaatcatgttgcattcacaggaccatgaagccaagggtgaaagtgtcaggttttaggtaggaaggaagaacaacccaaaagaagcaggcattttatgcttttcatgcatcgtctgaccaacctgacctagaagcctacatagattctcccaggagagcaatagacacacactatgtatctgggaaagtagtcataaagatttcagataaagtcctaagagggctaggccaacagtgggataagccaacctagctcagcttagtggcattttgtaaaccagtcacatgaagagataaaggcaagttataagcctagggccaggggactaaccactatagatgtggcttagaatggagtacatactgctcctacttagtattcattgttaaggcagcagagactcatacacagaaagaggtgcaaggaagaacccctattagtaaaagcatgtttctgagaacccaaataagggactgtcctaaatgaacttggaatagcattcaagtcactccccatcataggactgcaactacctgtttcagaaggaaaataagtaagaattcaccaaggagtgggccagaaatgtctaacggatagcaaagagtcagctttcaaggtgtgtttgtgtggaaagtaggtggctactccccttgaataatttgtgaggagtcagaagagctctaatgagtaaataccaacattttggttattcagagtttgtgcagcagttcacactgggtaccttgattgaggctggtactgattcaagagctctgggggaaaggaggcacagctgtcaatcagtggcattcctcaaaatcaagtgaacagcatcaagatgaagacgcagtgaaccattaggtttaggggctgatcagttgatcccatcactccctagtccccctacaacatcctcttctagcaattcccaggaccaatttattccaaccatctgctttttttctgcttctgctcccaagttgcaaatgctgctggagaaaatcggatacctctgccagctggcaccaggacaacctcagctgggctctccatgctgctcagcagtcttttcacgtgtcctaactaccttccattaacagtgcccagagcagctgttccaaactctacactcttcacatgcttcctggagctctcctccctttgcattctcagctactggccttgctctgacatcactgagaaaatagagggcatcaactctgtacccctactccctagtgtagcacctgagacatagtatgttgaaatggatcaatgaatgaataaattaattcactcatgaatgtaactggtaagcaccagtttctctttctctcttacctggtatcagatctatccttgcttcctgtacacatacctgggagggagggagaattctctgcctttccaaggccagtgcttccacctaagctcttgattctattaatatctgctcccctctcctctgggatcatttatataccctttcttctgtacctctctttccatcttctaccttttagcccacaaacatgcttaagtctctgtctctgtctcctacaactagtatgtcctgagcaacttttatgtgccaggcactgtttctagcactacagagatattagtggggaaaaacatatagaacatctgccctttaatggaggtgggtggatgcagataataaggtaatgagggatacaaataaatgaatttaaaatagatgtttataaatttcttagaaaaaatacaaacagggaatgggggcagagtctactagggagggagagggagtagggatgctactttaaataaagcagctagatataggtgacattcaagccatgatatgaaggaggtaaagaagccaagtgaagactctgcattcaaagcagaggaaacagccatgtgaacgtcctgtgtcagggcagagtgtccttagcacaaatcaagaagcaaaggagactgtgtggcaggagctgagcgagaggtggaactttagtaggatacaggtcaggggaccagatcttgagggccttgtgaagcatcgtgactaaggactttggcttttgctctggggaaaatgggaagctggtgggaaggttttgagtagaggagtggcatggtccaatatatttaagaggatccctccagcttctgtgttatgaattgagtagagtggggtggaggaagaagtgggaaccctggttaggaagtgattgcaatcatctgagagagaagtgctgtgcacgattgcatcctcatttgccaccacatttgtcaaaaggactgtttcactcatcgcctccatactttctgtcctcatctagtcccatctggttcatgcccccagtgctcttctgaaaatactcttggctgagatcacaaatgacctaagtaccaaatgtcaaacccaggggcttctcttcagtatctgaggctcctttataaaacctcagggccaaagcaagcccaactgtgtcttgacctataaaagtaacaccacgtaagaagatcccacctggcaggtttaatgaaatcatgacagccacagagacttgaatttccctttctaatttccttcaagcagggtttgcagactgaaatctgacaaaggctgacaggtaatgggcgtgagtgaaggtggatggaaatgggatgacccctctaaggtggtaaatgcttctcacttacacatgatacgtaccaggtgaaaaagtggctcagggtagccaggctttggaatttttcaaaagaatcctgaaatctgaagttttagtgaagtttctccatttgtaaaaattgataactaaatttttttttaaaatacctatagaccaaatagaacctgtctgtgagtcatataaaactgcagaccaccagttttcaaatcctcacagaggaattgctaagtgcagtggtgaagcctccgggcttcggtctggtgctctgtaaatgctgtggatatgctgatggtaagtgttactcatcatttccccaattctcagccttacactcctgcaggcaactctaggttttgacattctattgctcacattttctttttgagttcctgttgcctgtcccacaaacttgcattttcaatcacatactgaccttttggcccatcactccctggctgtgaatctaccacacttttcttctgctcactccacctctcaccagacataccagattccttcctggttctctctgcaggaactcactctctcagccactgtttaggtcatttctagtttcctggagcagataggtccagattcaaatccctgctgacttgcttaatagacattctaagcttaaggatgtcatacaacttcctcatgcctcaattttctagatcataaattggatttttcctccacccacctttccctccccgctacccccacataccactcttttccaaactcttttgatgaaacttcttctttctacaccttaaatattggtgtttcccccagagttctgcctttatgttctcatctgagcctatgcatcaagggtggttcttttacttttttaacttcaaataatatctccattccgaggtcttacaacaaagctagtcttagcctgtttgttaagcttcaaactcctttttctaatgatctcttgaccacctgggtgcccctgttttacctcaaattcaacatagataaaactaagcctattattttcttcttaatcttccatcttatttataccactccccttttttctctgcgatattgctcacagtagtaacccgcgctgcttaaacagataaaccacaaatcttaatggcttagcacaataaaacctgactgcttgctcccactccactggatatcacagtccattgcagtcccacaggggttggggaggttccgctctatacacattttagggtcaaattccttccatcctgtgatgtggccattgtcaataccttacccggaagtttagtgcagatggggaagagagaatgaatagggccagaagcagtatgtatataacttctgcccacattctattgagcaaaactcagatacataatcccaactaattgcaaaagtttgggaaatcaagtttagctctatgttcagaaagaaaagaagaaataagaatattggacactactaggattctcagctatgctactgagtcttccaaaatagaaacctgaggataacctcaactttaggtttgggtcttagtagttctacctcagaaaagttcagcatattctctttgcaatccctatccttgtcacttctcactggcacttttgacacagctttcctctcttcactggattcctactgcttgcatccaggagaaagtccaagtttgcccaagccagctctggccttttcagttctctccttcaatccctcctgcaactcactgtatgctatgcaccaaacttccttctttcttcaaacaatttgcttccaagctctgtgtgtatgccagggtgttctgtgttctagaacgcctagtcctgccttggtcacttcaaaaaccttctttgagcatcaagatccacctcaaatattactttttttaagaagctttaccaaatcccttaggattaatgtccatagcagttcatatagcactataacatcttggcacatttagttatagataattttatatgtctatatctcccataagactgggaatttcttgaaaggaaagaccatgtttttttttttttttttgtactttaagttatagggtacatgtgcacaacgtgcaggtttgttacatatgtatacatgagccatgttggtgtgctgtacccattaactcgttatttacattaggtatatctccgaatgctatccttctcccctccccccaccccatgacaagccctggtgtgtgatgttccccttcctgtgtccaaggttctcattgttcaattcccacctctaagtgagaacatgtggtgtttggttttttgtccttgcgatagttttctgagaatgatgatttccagcttcatccatgtccctgcaaaggacatgaactcatccctttttatggctgcatagtattccaaagaacatgttttgtatacagttctactgaccagatttgtaatccctgagtcctgttcaaagcttgtacattgtgggtgctcatttgatgtttgatgaatacatgtatcactataatggaaattagaacactatatttttatttttggaaaaaaacttaacccatcatttttctgtacttcagagttttatcatttgtcctataggagtttttagctctaaatatcattggatttaggaggaaacattatcaaaagcagcactcttcattagccaagttagcagatttttctctgaagattatatagaatcttacaataaatcctcagctacatttcaacaagaggcagggttttctaggattttaacctcttggtctaatcagttttacaaattgtcaatcttaaaatcctttagagcctcctaaaagagaggaaccattttgttggttatctgggagctggttgtttcttccacttcatcttatgtagagtcatgcccatgcccaataagaaagggaacaaaggcagggaaaagctgtgaatctcaactaatccagtgctgcatgagttgaaacagtggataaaggatagaatgggttctggcactgcctagtaatttcagacttccttgcttttcttgtcctacttatcatgaagcattaggaatgagcccatcattgaattagatatgccaagaacactattttgcttaccagcttctctacctctcatacccaaatggagtgtgaaggtagtgaattaaaattatttatgccatggcctcatctatcatgcctatgtaaatgagtcccacatatatgtcttaagtttagactcctcttccatgtgcactgtatctgactgactcttgccatttccactcagatgacccacaagaatctctaattcagcatgtcaaaaactgaatcaccttcacttctaagcctactgcaacttctctctttccttgctcaattaataatagcgtcattctccaagtgggacaggattaaaaacacaaagtcatctttgacagcttatatatcccatcaacaatcacttagtaagccacgttcattctgtctctgctaactcacttatggtaagattcatgttactctttttagagaaacctcttcaactaccggcagcccagagctgaacactcataatgtcagcctcaaaaaggagagtccagtctagtgccaacaagacagaatcacagcaacaaactgatcccatccaagttctcactctggcttttcacccctgactgtcttaactgtcagctctaagtatctgtaacaactccaaaaaaggaacttgtagacttttcaagaatgaactcattatagatggttggaaatatatacatatataatttatatatatataaaatatgatttatatatatatatgattttatgtatatatatatgatttttttcaggcagtggctcactctgttgcccaggcaggagtgcagtggcacagtcatggctcactataacttcaaactctagggctcaagggatcctcctgtcacagtcttccaagtagctaggactacaggcactcaccacaacactcagcttattttttaaaatttcgttgtagagatggggccttatcatgttgcctaggctggtcttgaactcctggcttcaggatatcctcccatcttggcctcccaaactgctaggattacagacatgaaccactcttcccagcctttacgatataagattttaaagggatattagaggagccagaactgaacactggtagatggtctttgtgtactgggctatccagcttcctaattatacaatgtgtttgggagaattgaagggttataaaacatttgggaaacactaaaaaaggtacttagccacatttcttgagatatatagtgccagcaagcaatgtggacaaaaacttgagcctaatccacagttagggtcaaatatctaaagaggctcacctgggagcattttgcacagaggaagggagatgctgtggaaaaatggaaaggactgtgttagttggcccaaaagcttcgggcacagggaccccatcttcatgatggtcatgaacatcagaaaggtatttcctactggtctaaaactgaaaagcattggagggcagaggaataaaagaggttagcagtgtcgtgggcatgctattggcagcaaattgtgggtggcacagcaacagtggtcaaatagcaaggcctgtattggtaaggcctgtagactccaaaaagatgagactgcagaagtggaagtatgagctccaattaaatgagacatcccctctcctggagggagaatgaatttttagagtgaataatttttacaaagcttctaaatttggtttcctgaaaatcaaagcattgtgcctcgcaacgctgaaagataataggagtggcccggggcttaatagtttatgtatttaagtataacaaattattaaaagcactccttggttaccaatatctcttctggttctcctttctaaagaaaaatattggtctggatccttctttctaacttacatgcagtctttgtccccaaatcatctaagtctagatatcttgtttcttactccagggaccttagtacctaagttttgtcatttgcttatgcactggctccaggtattaccttatgaactgagtgcttacaatgcattcagcaaaattcagactgtggctgtgtgatgctgccactctgtctccctagacagggtgagcctatgtctgtttcacgaccctttgtggccaacttgttgctggcataatcagtgttctggaatatcctgagatcttaggtggaggttttcaaaccctcctttgaaggaagtatggcttcttccttaatgatggggctaataaaaaatattaaatatatcatagtagtcacaatttctttctccattgtaaagaacttgtgactactatgatatatttagtattttattattaattacctatcttgtagtctgtaactatgtaccagctataatttcattcagatcctctttgcttctgtctaggattccatatgtgttttgtttttcctgaattagactctagccctatctctgaatagtaactagaactgcatcatttctcaaggcaagaagaaacccctctaaaaatgaatgaataaatgggaaatcagtcaaataaaaaaaaagttaagacctccagcaaaaatactcatagatgctcatcagtgtcccacctgactccacacagtatggccctctaggatttcatgtttgcatataacctttgggtgagagaatgatctgctgctaggtagatatgattggttaaaattaatacttgtatatgtatttccctactattactttagtttcttttattaaaacttgtaaaagtcttctaatttggcttctgtatttctgagcatttcctttcttaaccagagttcttcatctgaatatgacttaagtaactattttcttagttctcctaagcatggttcctaactacagtagcaccattctagatgcacagggaacaagttaatttattatgtaaaatatatactttgaaagcattaaggcttaattcttagttgaaaaaaaaaagtagggttgggatggaaactctatgttaatcttcttagattactcttttgttcatgtttcacatcatcagcctgcgcagaatctaccagtggctccctggtacctatacaattaggtttaaacccttagcatgtagagctccctataatctggactcaacctacactgtatctcttctctctctttatctgggccactgggcttcactctagttctccatcccaccctgaaccaaaccagaatgtactcttccaacttcctcctccctctccactaccccagtccctgactttcatctctgtatgtctcattttactcatttttcaaggtcaagcttagattttatattctacataaatttttttttgattctcccttctaccgaatctctaccacattttactttttaaaaatttttgtaatacttttcactatcttttgagtgcatatcttatcaactgctccagcctgaaagtcctctgagtaaaactgtgttttacgtgtatttgcatcctcttttaccccttatccccatgactaaaagatgtaaggtcaataaagctttggagagagaaagaatgaatgaatgaatgggaagcggaatacattggcacttgtctactggtataccacaggttcagacttcaacaggttaagcaggcgaggcttggaagagaaagcatccttgacataagtgagctttctctctctacatgcttgtgtgttacatgacatggtatgatgccttaaactcccgtcaaaaatctacatgcccccctacttcctctaagagccttaaaccaaatcttttctcttaggttgtcctccagaatttctcaccgcatgctttaacaccttgtacacagtatttaagtagtatctccaaatgtgaatactcattatgcccaccattatatatataattactcatctttgacagtaaatgttaaatatttattcctatacttaaacataatgcacaggattcctttttagtgactgctaatgagttacttttttctaaatcagccgaaacatgaaaattaagcatttttttctgctcagaaataatttcaatgataatagtgttaaaactttgcatttctaaagtacactgtatttgagaattctacagaattgttggaacataagtcatgcaaaggtatgaatcagtcagcacttcagtaggaatattagctttatacccagaaagcacttaacagcctttgccacctgaaaaaaagataggataagaataatttctcaagagccaggatctaggaccacatttacctttcagatttaaaatatgaaggcttttcattttcacagcctttgattgtactatgtcccataatgttattttttttttaattgcttctattctttcctggtaggagactaccatgtaaccccttttgatttccgagagatgtggaatgcagatctgtaacactgcattttcataactcttcctttttgctttggatatatttttgtcattaatatagtactggcaggtctgaatgtgttttcctaaccttattccatcctccctttgctaggagttaatttagtgagagctcaacccacataaatatacgcttataaagcacaaatgctccccaatcataaagaaaatgccccatgagatactgatcaagggacatttttttagattaaaggctaaaagatatctttacatcaagctcagctgagtaaaacgtttattttcttattcatgtatggtgagaaaatttaaattgacatttcaatcattcaaaataatgaatatctgaagtgcaggaataaagacaacatgtgtgtatcatttagaacagaaagcttttcctctgtaactggtaaaccaaaaatagattgtattttcttccaaagaattataatcttttattaggatatattctaggtaagtaatttgtgtttctgctgaaggggacatgacacagaaaaccattatttgtattttaagtagttgtctcactttgcaccgagggagcaaagaccaagtattttccatatagtacttgctctggatcaaatacttttaaagtaaatgcactaataagcttggatcccatgaaggtgcttatcctacaggcagttttgggcacatggccagtcgtgacctgagaatgcactgaggtattaaacatcaaacattctcccttcttctttccttcccctttatccacaaacaacattgtttttaagatttcctaagcaaaccaggaaccttgagaagttattgtttttgacttaaatgttggctgacttaaattgtttcatggtaaacaagcattttcctgcccctataaccatataaaagtccgttgggagacccagaagttgaaatggtaactatattctgttgtgagccaggaatctgtgggtgagcatatgggaaggcacttttattagcagccctggtatattgtgcctggttctcatcctgagataagggatgaaggatgcatagaatccagagtgatattcttgattggttgaaggcccaccttcccctctcctgtttgaaaacatggcttaaaaataaatgggtcagaaagcctcacccaatgaaaagtgaggaatataatatatagtcctccacattttcattttggagaccctgggtgtattagtctgttctcatgctgctaatacatacctgagactgggtaatttataaaggaaagaggtttaattgactcacagttccacatggctgggaaggcctcacaatcatggcggaagacgaatgagaagcaaagtcagaactcccctttgtaaaaccatcagatcttgtgagacatattcattatcacaagaacaacatgggaaagatccacgcccatggatctttacctcctatgggtccctcctatgacacgtggaaattgtggaagctacaaatcaagatgagatttgggaacacagccaagccatatcactcggtttacatgtattgctgctttttcattaaagaaaaaaatgtgttacaagccaactaataaccaataaatgatcttgctcttattaccaaatatgtttcctaagtagggaatgctggaagggagggaggagtcaaaaagactaaagggtaagtgtaaagaaagagaaatcatctacctttgctcttcttcccacgacctcatcaccatgcttgaaaagagtcaatgagcttttcaggatcattagcatacttccataggctgtgtgagatgcaggtctaagagcagacctcagatctaaaggaaagcacggcattatctatctcacccacacagtcaaagcattgtctccttatggcttatccatgtgtctggtgtgtatcccacaggaaagcagtggagaaggtaaggatgaaaagctaaactcaacatcatgcagcagttgtggtaggctggattttacacctgggaacaagggtgcctaactgtcccagtttgcacaggactgagggaaatttctaagacacagcattttatagttttaaaaccagaacattcctgaccaaacccagacaattggtcattctgaaaacctaggatttaggttctcttcatcattgaagtcttctagaacccatactttcaaaattatctgcacgatggaaacgtctacggcattttaaaagcaactgatgtgggtgtcccaccccccataaaatctgacttcattggtctgggatgcagcctggcccttgggagttcttaaagctcctcaagatccccagctaattataatgtgcaggacagattggcaacccctgcactaagtgattttgctaaattatttaacctctctgagcctatttttcttttggtaaaaatttgccctacttctttgcatattacctctgtacaaatattcaagcttctactatttggaatgttctgaatcagtgcataggaatcaatcacctaaggatcttgttcagtgaagatgctgattcagtaggtatgagaggtggctagagaactcacatttctaacaagatcccaagtgatgctgttgctgttggtccagtgtgtaattgagtttgtggtaggcaaaataatgcctccacacaaggtgttcacatcctaatctctaggacctgtgaatgtgttatgttatttgaaaagggggattaaggttgcagatggaattacagttgctaatcagctgacttcaaaatagatcaactgacttcaaaatagattaccctggattattcaggtaaatctaatatgatcacaagggtccgtgaagcaggggaaatgatgtagaataatcagtttcagagtgctgcaatacgaggaagccagccattgctggctttgaagatagaagggaacccagaggtaagaaatttgtgaagcttctagatgctggaaattgcaaagaaacagattttctcctagagcctccagaaaggaacttggccctgctaaggacacactgatgtttgcccagtgaagcttctgtcagacttttagacctacagaactgtaagataatagacttgcaacatttcaaggtctttattgttatttggaacagcagcaataggaaagtaatacaagtatgatattaatccacaactcaggagagcagtaaacacagtttcattgttcattaagccagtttctcactctgagtcattctcccagacctgaacctcagcccttcctggggttttgaaactccaccacccctaccttcaaatttggctatagttcttgagtccagcgtttagggatgcattggaggcagctggctggtccatcatccttttccccagtggcacacttataggtgcaatcttggtggggggctgcctgtggtggaacaggcgactccagacagacaggagggacgcacagttccctcccactctctttccttggcctctcctccccgccccttcagcacagcccaggagaatgtggcttgtctcagctcttctcctgccctggttcttccatgctctgtgtatatctctatgaattctctaaattatcccaaatgtttgagctttggaaaacaaagttcaggaaaatgtgcaggttatttttattttctttcggaccgcacggcttgcctgagacactgagcccagctggctccaccgcaaagtaggggaaaaagggaacagacccaatctaggaagtaaagaacatgattcagtttgtcaaaaaaaaaaatctacttatgtgtgagaagtgagcacaattaagtttcttttatacgccccctcaccccccgccagccccccgcataggaaagttcctactgcggtacatgtgccgcatctgcccagcgcgtccagaagtagaaaggcatcgggcttcctaaggatatccgcggccagttgaaaggagcacaagaggctccgagataagacgaccagggccagaaagttcaatgcatcatttcaagattcgatgtcttggaaactagactccttctcagatcttaaaggtgaaatgagtggccactactggcagccccacaacagcacgcattgggcaacaggcctgagccccacacatctccggatgatacacacctgccccatgggaagccccgggagctcagagctgaaaatagttttgcgtggagctgccgctaggctggcttcctttctgaacctgaccacggagttccttacgatttccacggcaaagaaatactctctatgtaaattgtaagcattttctctgtagatttcagttgtcgatgactacctcataagttgtaataaaatccagttttattaagagattgagactcaagaaatctcttgagaagaacatacagaaaaatgttaagggattaatttgggagtagaattgtgggtaatttttttctttatgtttttctgtattttctcactttctagaagaatgtgttttgtctatatactttgaaaaataagtttttaattacttaagaagaattatggagagtttacgctctttggcttgaattggagagggtaacagtttggagaaggctatttcccctacatacagaccttagagagatatatctgccagcctcactgggctgggactagaatcacctttagataccatgaataataagcacagtaaaagtaacactaatgacaccagatgatgtctgtgttctttggtgtgcacggtcccatttgcatctaaggactgtggagagctctgtgcctaggtcggcgggaatgacaccctcattcttcaggttctgacgttcaagtcagtgctgttagattctcagctgtcctaactccttttcctgggtgcggaacactcccctccctccactgttgttggctagggattccaaactaaacagacatcaagacttttctttttttcaagaataggtgctgcagataaagcccaaaatacagagaaaaccttaccacagaaatgcaggttggaggaacagagagcgagagggcaggtgcagttcttgcctgccttctgccaggcccatgtcaccagttcactgtttatttcttcaccaagcctgctattagcagtaggtctgaaagctttgaacttaactgatgtacgtaaagcaagctgttcatttaatctgcacacttaattcagctctctctgcatgctgcttcagtctggcttctttccatataaggagttcaccgtatctttctgcagcacccctacctctgtcttgaaaaacagccaaagatggctttgtgtttaatgcacttgctgtaggctgaaagccccagctgcactgccaccaccttgccccctactcctgccaggtaagtcctgtgtggtccatttccatctcatcctcaaatgagaacctgctgaattctattattttgagacttttttatgtaaatgaagggaaagaaagtcagttttaattttgcctgtctgatagattatatcagaaacaaatgcatttatgtgtgtataatttcctgttcatgaaaatgttgctggaccctgctttagtgcaccttaaggcagatttggtgaaagctttaggcacacttctgagtaaaatatgcatttcaaatgcactaataaagtgtgtagaattgaacagtgggtgggagagaaaggagggacattttctcacttgtgtataatgttcttttctaagtaaatactggtaaagtctatgtataatcacaattttattgaaaggttaagtaggtggctccattttgttgttatcataaataagcaatatttgctacagaaatctcacattttggataatggtatgtaaatatatcatattccttctttcctaagtggtttccatggcttaatgcctgtcaaggttttgtgaaatatctgcaaaaccagatgataccactcagacgaagggaagagtgaggagatttaaaaatagaggctagctttaggagtctatgctaaggaacatgggcacgtgaatctgggaatgggggtgcatgcgtgcatgcagccaggggaaagaaatagtcattaaaagccatgagagaaggaaaatgcattataaatacaaaattgggaaaataaaatttagatgctaagccaggccttggtggggagaaaaatggaaccactcttatttggttatgccttatcaccgctgttctgcttggggtaccagctgcctcatttagagcccgttcttctcacaacattaaccaaggtgaaaatattattaaaccctgacagtgaatgacagaagcttgagatatagtgcgtatatctactcaggcatggctgtagaccccaaaccagatacccttaagcctattatccgcagaataacagacatttgctcctatcattatacatgtgaactgtgtaccttatttcaacagttattatcagtatattaaacagctacaaaatagctggccctgtgttttctgttttattggaagtatctcatttatctagagtcttctgaaagtcaatactattcccatttttacaaataagaaaaatgttagggctcaaggaagttaagtatctcagccagggccacacagttaatgagtggaggagacaggatttgaactcagatccatatacctgggaaagtttatgttctttccacttttaagcagcctctttatttaattggaaaaattcatagaattataagataggaataagtgagaaaaggaacatacaaataaaaccattttcttgggaatattggaaccacagcttaagtaaataattctatcctgaagtgttttgatttgttggctgaattttccagtagttgaaacattagccagacacaccagggcattatttctctatgttggttgcacattttaccaacctgaagagctttaaaaaatagttacgtctaatctccactcccagagcttctgattaaattggtctgagatgtggcttggacattatgggttttaaaagctccccaggtgatcctaatatgtagccaaataagtattttccccttaacggcctctcctaaagtctagacccattaattcagctaactcttagctatctctgctttaatatcccataggcatctcaaactcagcatgtccaaaatagggctttacatcttttcacttaaacctgaccctcatcttcctatatgatattttttaatgccaaacactatcactagacttattattctaagttagtcatatttttatctgagttctgaaattaaaataggcatgcctgaccactagatggctgctatataaattcataaatatttgcatctgtgggatttcaaaagagtagcaaattcaaaccctgattagttttagaaatgttgtaatagctccctcctgaatgccaaaggaagacaatgctcaaattaaatgctctacatcaggaagttaatttaaatgagcatgtgagccttattgtccataagaaagtgagtgtggagcatttaaacccgcaaggaatgccaggttccacagggaaacaaggaccactagccctgatatgcaggctctacaataaaaatcaaatctaatatattatgcgggaaaaaaacaaacaaggaccactagagcctactctctgcttccccgttgatgcaagggtattgcactttttcagaggttcacactctacatggcaaagaatggtacatggcctaagagaagaaaaaatgatgtctctatagtaactgtgatcatttctattataattatttgataaaaacccaactcaattttcctgaaggaaaaaaaatcaagaagccattggcccacataactgaagggttcagaggtgatctagcatcaggcataaataaatccagaaggcccgtggtgacaacacaggtctgtctcgctggatcagtttcccccttccattctcttgttcctcctttctcactctgtctggtcctgctctgcctcaaatttggctttattttgatttcagagctgagatcaaagttatgagtaataagtctggctacatataatttttgacattaaaaaaaaaaacatatatgaagaagaagcttactctcagtcaagccctttacccatggcagcttccacaaatctcgatttctgtccctccagttcttagtccaccaaagtcattttctttcttacagcagtctcacaaaaagccttgtgattgaggcttactggacccaggcttgaactaagttcagtagccagggggatttccttgactaggcctttaccatgggcccttccaaggaatcaagagagagttggcgtgctcaaaccacctgggactcacaatgggagaagggtgaatacacaggagaaatgtgggctccgttacaacatgaagagttagatgttgggctggacaaagtaaggaatccccagtgcaaactctgcaggtgcagagagaaagagatctcatccatctggggatataagaggattttcaagaaggtatgattagggatgagtcttggaggattggctagttaagaggagatataaaataaatttaattttgttgaaacataattcatgtcctccaggacctcctccatagttatgaatctaagaagctacttaatctatttggtgcttaaataaaaatgttttgatttcataaataaagattttgtttataataaaagagactgtatcattcagatactcagataagcaggtctctaccatcaggtataatgatatcttttaaagtgagagcctcccaaactttagtaattatttcctcacatgagcattccagtattttcatgaaactctaaaaagtgagaatttatgatacttagaagcagtttgatgttgggaaaatatttatttttggcactggccttccatgtaactgtaggcaagtcatttaagtggtttacttatttctaaaatggagatgatattggccagtaataacaatgactgataataaagttgttgtaaatggcaaaggaaataatgcaaatgaaatagcaagtactatacaaataagtgtgagatggtgtcattgtacagttttcaaagtaatatcttatatgaggaaattagttgataatgggagggtttgtttctttgcatggcaagccatctccattttatcttcattaaattcaccaccagagcttattataataatttagcattatgggtaaaattgtgttagtgtttactttggaaatatataaacctggtggcttctatatctggaatacttccaggaattaaggaaaaggtgaagggagcagcttccaggcacctaacaataacagccctatggctatgggggcaaaaccttttcctcatgcagtaatggggattactcataggctagcagaaatggtccaaaccaaccatctgaagaaggaaccaagtgcacggaaaaaagcaagaaattttacaaaggaaaggggaaagtggaaacaaaagagaggagagcaacagatgcaaatgcaagggactagtacagtgcagtggaaattagagccagaggcggaagctgtgaaccacacatggaaacattgattttggtgagggaggggggagatgaaggggagtgatagtatacctactagattcgactccagagcagaatgtttcccaacaacccttcctatagatggccaagctattttcgttaataattgtgatgtggaatgaataataatagcctgaaacaaacacagtaaaaatcttcttttactgaactttgtgtgtgtgtgtgtatgtgtatatataaaaccttgtgtatatatacacacacacaaagtttaataaaagatttatatatatataatcattatatatgtaattaattgttagtaattgttagaatttacactaagaaaagattttttgagggcaggagtattttatcattgacattgttttgattctcatgtttgctagcacatggcaataatagaaaaatatttagagtgttatattattgttctaaaattctgtatgtccaatgcacattcttattgcttgtacctgagggagaaccctgtcacaaatggaggggagtcagcagcccaaacagaaaaatatttggttcactctgcagagaagggacacacagcctcaaacctctcagtgggccctaagggctttgctgaactgtacagcctgtggatacaataccaaaagagaaatttcttcagaattccctcagaggaaaagcttctcttatgtttcctactttaagaattcctggccgggcgcggtggctcgtgcctgtaatcccagcactttggggggccgaggcaggcagatcacgaggtcaagagatcgagactatcctggccaacatggtgaaaccctgtctctactaaaaatacaaaaattagctgggcgtggtggcacacgcctgtagtcccagctactcaggaggctgaggcaggagaatcgcttgaatccaggaggcggaggttgcagtgagccaagatcgtgccgctgcactccacctcaaaaaaaaaaaaaaaaaaattcctaagtgttacagacttcattttgccactttttttttttttgctttggcagagtacagaataagtaaatgtacacacacatatacacatgcacacatacatatagtttgtagtcccagtgtggggagcttttaaaagtctgatttctgaaccttatctctggagagactcactaagtctgggatgaggaccaagaatctacattttaaaagcatctgtgtatttctgatggtcatctaggtggaggaatcattggtgatgaatttgcatttttctagctctatgcttgtaatattccacttcaattaaatatctatggtcctgattatacatttctattgtgtgagtttattgtctatcttcttattttatcttggagatcaccttaatatagaattggaatttaattgttaggagaataaaatcctctttctcctttcctgaaaccatgatttctcccaagtataaatgcagaatgtgaagcctccggtttgagaggtcataaatcagcagcaagtttctcagcagggtgtatattaaaatggaaggccttctattcttacagcaggtcactaaagttataccagcaaatgcaatgaaaattcacagtgctttttacaccctcatatattactagattctcccttagaagtgtataaaactgttttctctacttaaataatgccccccatttttttctttttcttttctttccttttttttttgtggttcttcagacagaatttacaatttaaaagaaaacagaggaagaaaagtagaaaaaaagctggcatgacacaaaacaaaacacagaagcttgtgggaaccatgataacttactgatttttctggctgcaagattgtatgaaacaaaaaatagcaatatataacacttccagtttccccccgaagcaggcatgaccaagctcgttgtggtccagattgtctaaccagttatgctttaaaaaaaaaaaacattcttctgttgtctgtgtctttactaaacctcaaatgccagtcggtgtgaatattcaccaatctattcagtttcatcatgtaagaatcactgtttttaattatttattaaaaaaacatttattaagtgttaagtattatagacaaaggactaaatgatgctttaattctcgtaacgtctctatgaaagtggttttccccccattttacagatggagaaagtgaggcgcagaggagttcagttactttctcaaatgattcagctaatgtatttcttgtattttgatgtatggatgtatcaccactgggaacttatttaaaatgctgattactcctagggattccccttcagtaggttctgtggagcccaggaatctgcattgctaacaagcaccaggtgaacctgatgcagatagttcatttagaaaaagattattgatatggtttggctgtgtccccgccctaatctcatcttgaatcgtagttcccataactcccatgtgttgtgggagacacccggtgggaggtatttgaaccatgggggcgggtttttcccatgctattctcaggatagtgagtaagtctcctgagatctgatggttttgtaaaggggagttcccctacacatgctctctttgcctgtcaccatgtaagatgtgattttgctcctcctttgccttttgccatgattgtggggcctccccagccatgtggaactgttagtcaattaaacctctttcctttataaattacccagtttcgggtatgtctttattagcagtataagaacggactaatatacttatagaatactatgggtttcccactctgaaagacagctcagagttcaggacatgaaggaagtcctcaccctgttccatttccattctatcacctggcatttgtcccctcagaactcaggccataggaagccacactccagcctacccatcctggcctgctgtgtaactttcaaccaaaagttttcttaactatagttgtgtaacttaaaaagtggttactgaaactgcatgttgtacttcattctgggtgaagggccaagagttgtgaaaattattgacagagtgggagctgacagaagaggctcaggagaaaagaagacaggtataactttatctgtctcactgggcctcccaacccataggccttccattcccttctaatggtgatttccattaaacagcagcacactcactcactgggagctgatgcaaagaaattctacagtggtggtagaaagaaagataggaggtagggcagaagtgtgggcataagatatagagaaagagaaaaaagcaggaaaaaagaagtgaaaaaaaggcagtggctgtgtagatggggggatcttgttaatagagtgaaacatggttaaggttaacagcacattgttcagaccaccaaaggtttgactgtattctctataattcctaggacaactgcaaattactagctccaggaaaattactcctctcagatctgcatctcctccaatcaggttcactgatatcatagcttttcccaacagatgacctttccctgtgattttgagataaagtgattggaaggtgggaaataaaaatctaacagggtctggggttctccaaagccttttagtgttagattttatggtgtttgctccaagtggtataaatacctttaggaatctcctcacctatgaaattagaaacttcttggaccatctttgaagaaagtgttacacaggttacagaaacacggtatgtagaaacactatatgtagcattagagaaatgctaagttgggctttaacacccatggcagatacatgacacttggcatgtcatgtaatttttctgtccttcagtttacccagctataacatggaggttataatccaccacccagagtggtggagaagactaagtgaataattatttaatacagaacctgacagatagaaggtatatcaggatgtaacagggtcctggcaggaaacagaagccatcccacatgagtcaatggaagagaattgtaaagagattatttacaaaagtgttggcaggaatataaaaatgggatggcgaggcacctggagactgtcatgcaggaaaccattactactcatagctgaaggcaaagaagatagaaagagtatctatctccggtgagtgcaggagctgtggaggagaagcctgtaagagctatagcctggagaaacccagctactgccagagaagcaggagcaagagaccttttcctcttcccagcgtatgagctgctgctggaggttcctatggccaaactcaactggaaggcacatgagaaagaagcctagatggtagagttcatagcagtcatcttccctgggcacagagataggcatggaatggatgggaaggaggaggtgcagaggggttattcaataaagtcatttctacctttcatttctgacccactacacacacacacagacacacacacacacacctaccttccctcatatttccaaacaaaactgcatatgtagtattgtgagaagcaggtggtatttaactaataattccactaatgtttatttgctaagtccagtaatgaattcaagctaaatattgtttcttctcccaaagttcagggccattagtggctatgtgtacttggcaagacatattaactcttggactcaaatccagttttttggatacataaatatcctctagctcactgagagagttaatgtgcttccctaaagaccttactaactgactggcagtgagtgaattcagcaccaaggatatcagactccctggaagacaaaaaaaaaaaaaaatatgtatatatataatatatatatatatatatatatatatatacacagagagagagagagaaatttaaaaattagcaaggagctcagtgtgtagtgctgctgcctccacttcccactcactgttcttccccaggactccttctttaggtaatggcttctcagcaactggagctgcctcccgttggaaaagataaacgtcctccttccctccatagagatagagaagagtcagattggtggagatgtctggaccttgtgagcctatagcagggaccagcaaagaagctattcatgctgtgggtcttgagatggaagcagaggcataactggaaaacaagcgctgtgaatcatttggtcagtcttgaagtatcatttagagctccaagaaagagggaaatcttttaaccacaggcctacaggacatctggaaattctatggtcaaggtatccccattatggtttctcccataggcaagataagatttggcgactaatttgtgctcgactacaacaacattaaattgacattttaacttctggtgcacaggataaaataataattagcattataaataatagagagcacttgtcaaatgcctggtgtagtccaggcatgtgtcaagagtttttttgtcctaattctcacaagtcttatggcagatactattaggttattatattagactattagattataacacattaaacttaaagagtaatcattcagaacatacttggcgggggggcctcctctttacagaagaatgccagctaatatagggaaaatgacacatagaaaatcacaatttttcaaccatgattgtagtcattgattcaggcagaggtcatcaatggatgctaaaacatcctggttaaaagttgctagaggatagactataagaggtacagtctcaaagcgtcatgccacaggttagtttttaattacaaagggaaaaaaagatacttttacaatagaaaaatctagctgatgatatactaaccaagtgagcagagttaacctcagcagtaatgagacaaactgacctgatatgcctcgtgatggtttgtcatgggaagtgctcaacatcatcatatatacaggttgagcatccctaaaccaaaaatccaagattcaaaatgctctgaaatccaaaagaggaccaacatgacatcacaggtagaaaattccacacctgacctcatttgattggtcataatcaaaactgattcaaactttgtttcatgaacaaaaagtatttaaaatattgtataaaattaccttcaggctatgtgtataagttgagtatgaaacgtaaatgaatttcatgtttacacttgggtcccatcctgaaagtatctcattatagttatgcaaatatttcaaaatctggaaaaacatttgaaatcataaacacttcttgtccccagcagtttagataaggtatactaaacctgtagtattcttattgaaatgtttaacctgaatccagttgtgaggaaacagacaaattcagatttggggacattctacaacttgccacaactagcttggactatccaaaaatattaacataataaaaaatgaaaaagttcgggaggagtctaaactgaaagactgctgagacaatagctaaatgtaataatgtgtgctccttaactggatcctggggggaagaaacattaggtatgaagacattactgggataattggggaaatttgaatatggggtacatattcatgttacagtattcagagtcagagtttcctggttgatttagtgcaactgaagttatggaggagatggttttctattcttaggagatgtctgtgaagtgtttaagggtcatcaagtctgcaacttactttgaaatagatcaacaaccactgcgaagtgttatatgaaaagagacaaagcaaatgtggcaaaatgtccacagctgaggaactgaagtgaaaactagatgtatggcaacttctacttgtctacaggctttaatttttttttttaatgaagagttggggaagaaagggtagtattattggtcctactttttcaaaatgtaaaccaagcttgaggtgtcccagctagtacatgctagagctgatattcaagtccaggtctttctgactctactaaccccttcaatacattttggccttagaataatcaatgtgaacacaatcaacgtgaaatggtctttaaaatgtacgccattcatttctctaagtccctcatgactgaaacaaacaaggaattgggtttggtttgcagttgtgctgtgctcccctccacacccccacactctcagtctcctcactcagggaaggagaaaggcacttccctcttatatgaatattactgaattcattccatgtcaatcattaaggcctaatgtaaactcttgtagcatgctgggatctaaatgaatcctgacttttcatcatctcagaacacaaaacctaggagataagagaagacaactttaaagatagctttaatagaagtcaatgtaatatacagttgtagttacactgataacacctgaacaaaaaaagagtgagaaaaagggcatttcttcaaatcagttgactccctttcttcaaagacattatcagctatttatgcaaacaatgatttattttacctggtatatatgaagtgattaatcatataaccttacagtatccatcttaggtaatacgtgctccacgtccatgaatttcaactaagctgcctagacttcccagtgagtggtgtttggaagtttaaatttttacaccttatgttgctacctaatacaattctttggcatttgagccagattcttatttaaatgtcttcagtcaatataactagtcataaagcaaactcattctttggtggttatgagaagcagcctcacttctctctttgtttgcaccctacatttagtttttgaattttataaattgctgacaacagccagatctttttttggaaagtgatttaggcaggcaggagggaaacgctcacagtaagctagtggtgtcattagcaattttgttctttatagaacaggaaactataatcagtgtttttaagctattaattctataggctagtacttccctcccactaggaaatgcttattttctccacccctgaagatgggtgttttttaatgtttaagcaaatccctgccatgcctttgtctctgtaagtataatagaaacgctgtgcttctgtgctgcctgtggcgcgcgcatcagggcatccaggtatagctttgtgctgcctgtcagctgccacacgtggagggtgaagggcagggaaaatcacattttgtgggggactgtcgacattcttctgaatggaattctttggcaaacttgaggaaaaggaaaaaaataatgtgggagactggacagagtcagggtccccagggtgccaagtgtagctcagagtgaccattggtgaatcgcttcatctccatgtggaactaaatgcaactaagtgatttcttaggctttccccagtcattcttagtgaaaatatggacttcccacatcaattctgagtcactttcttcccacctggaatgattaccatttttctcatagtcagtgtatgcagcagcatataccctcatttgcctttgggtacattcctgagtcaagatacacaacaggatatcactggggctgcaaaagcccccgccccaaaagagacttggaaatattacgctcttcatgaggaatgtggctgtgcctctcttctccccagacctcttccttcttaccagctgggttgctttctttcttggactctagacagtttctagcaaagatacaagccattgaggaactgagataagaagcagaaaggctaggaccagaagtctcaagcagggttccaaggattacctctacagtcctgagcaaggccatgtttgcatgaaacgatgaacgatgggatgaggaaatgacaacatgcagtatttcatcatagtgtaatccatgaagctactgacacgtggcagggtgaagcatgaggcactagactacataggacctgtatgacatgagaactgatggaagcatatgagcatctggggcatctcagagccaaaggtaaaattaaaatccagccaatcactaaagactaggttcctatgcagactttgaatttttaaaatcctgaagttctttatcattggactacagcatggcatcatcccgtacccatggttatggataagtatgaaaattatgagatttgaaatttataatttaatcccagaaaggggatcttctattttctggccagaggccaactctctggagatgtaacaaagccaacagattatgagaccctcattggtttgcttgaagcagagctcttgaaatgttgcaatgtaaataacttgtaataccaggaccactttgtcagcaaccagcaaaggctgcttagggatatagtgaatctgctcctcaagtaaatcctgagaaatttaatgtcctccaagctttcagctttctagctatggctcctttagcaactgctactgacttcatgccacaacaacaagaacaaaaatatggagctgcattcttttccattctccataaaaccagcatccaaactgcgttaatatggatgtgtgaacatttagcactgacatacattgttcttactgaggaaagcattagacaaaatattttctcaatgaatcattagagtaatataactaagagaatattatatacatttagaagttttttttaatctaaagcatgagaaaatactgtatttgaaagttagaaaactgcatttagttatactaaatcaatctgactttcactcatcctcacaaaccccctttaccttcattttgaattagagagcttcttattgttatattatttataatggaactggtattcctggctggctaatgggcgagcacacattaattccaggttcaaaggaagacaaagaccctcttcagggttctttattgtttgtgcatctgagaaaatgcatttatagtgcagtgactctgtgtgcacactcccaaaggacagagaaatcatgcagaaacttcacatgcagagtttgcagaaagaaatgtcaactcatacctaacggccacggctgctgacataagaatgacaataattagactggtacatattagaagttgcaaccgttcttagaagtaggtatttaattaatggcttgatttcatcatctactaagagatgggtctaaaaagtattttctagccttttttgatgggctaagaatctgtacggaggattgctctaggtgtgaaatatagcaataggtgagatcacataagggtatgtactgaattcacacaggtttagataagaatcctgaattaggtgatttaaagtctaagctacaataataaaaagaccctacaatacaaggctaaatgacacaagacattgccttctatttcacttcataggacaactggactaagctaggagattgtccacaagatcattcagggacacaagttctttccagcttgctactgaagtcttcactgggatattaacatcatctgcatggcgaaagctggcttgtagccttagctacaaggctagggcacagaggcagtccagggcaaacacttgcctttgagggtagtaagacaaaggtagtacccatctattctgctctcattccattgaccagagcttagtcatatagccatattgagctatgtagaggctgggaaatggtgtctggctggtgaccatgcccctaagaagaataaaactagtttggaagagacaaatagcagtctactgtcagacttggacttttcactattgagtcagtattattttcaactgggcttctgatgtcagaagcactaaactggcaagctccatttctgggaaaagctgttaatgaagtgagatagatttgctgcactaggctaaaattttaggtttgtggtttttactgatgagcttaaaaatgcttttttatttttatttcagagactgtcaaaagtgaaaggtagcttttgatatatgagaatcagttagacttccattgaggtattcaacaaacttacaactatacttatactgctcactaccagaaataaattaattttcttagaaaaccagctctatgtctgtaaaaataaaaataaattctgatttttctatgccagtccattttctcatgaacagcttgttctgcaaatcatccgggactttgttagtgtcatatctgctgcacagcttgaggtgggtgattgattgtgcagtcaggttgaaaaggaccaatccttgacagaagatggctaggggatcaggaagataaaggcatctggaacaatgaactttaaaagaactcagtctgttctctgggcttcttaaaaatatgaaattcttggccgggcacagtggctcatgcctgtaatcccaacactttgggaggctgaggcgggtggatcacaaggtcaggagttcgagaccagcctggccaacatagtgaaaccccgtctctactaaaaatacaaaaaattagccaggcttggtggcaggcacctataatcccagctactcgggaggctgaggcaggacagtcacttgaacctgggaggcggaggttgcagtgagccgagatcgtgccattgcactccagcccaggtgacagtgcgagactctatcttaaaaaaaaaaaaaatgaaattcttaaaaactatcaggatctttagctaattattctttctctaaatccctttatctgtaggtagatttattcaatagaaatcactggtggcatgtcttaagatcaccaactttcttttcctttcctttctaggatagctggcaataagtagtgaccagctatattttttaattgtctccacattcaaatgccaggagccccatggattttaatcaggttttagaagcaggctgttttctttcttgtgtgttgtgcattcctattgcctcccccaggcctctaatcttgcagagtccccagaaattgctccattcaggaatgaattgttccattcagatttcttccttcacaggcacactctcaacccagggagggacatgagcaagccactcaggactgagcattaaatcacaagttcacagttgctttcttacacccagagaggcttttgtcttatttagcaccattgctaacacatctttagcaccttatttgcaatacaggcaagtttaggaaagaatgttaatataaagctggtttggcctgaatgccagggagagaaagtcacagtacacagtggggtgcatatgtgtgtgtgtgtgtgtgtgtgtatgtatgtatgtatcattaaaataacagcagcttctctccagagcaatgttcatacacaccattaaactaacatcctttcttgcaaaaagaacacccacatataggaaccatgactcctctatgagaaacataaaataaaaataaatttaatcaatagtttgtgctagtaaatgcctaaagataatgtttttgtgtggtcactttccttatttttttaacacaacatccattgacctatactgaatgttccatgttgtttgtacatactagatattgcagtagtaaaaagatcaaaactggggagaggcaaaggtatttttaaatttatttaagctttaatttattcagatatgtaaattttatttcagagctagaatggttcattttcaccaaagtgtactcattcattcattcatttattcaattataaactaaatacttattaggcactgttaaatacttgagagactacaagcaagtctccctattttgaagaatctaactccataactcagaaatttaaaaaaatactcatatataatgcttttatagcaatacaaaataatattctttagaattaagagccaaatgggcagtatagataccaagaagatgggaaatagcacttgaacaaggtggaacttgagctgggagttgaaagatggacagattgtgaatttgtagaaaagaaagaaccagcctggccaacatgatgaaacctcatccctactaaaaatacaaaaattagccaggtgtggtagtgcgcgcctataatcccatctacacagggggctgaagcatgagaatctcttaaacctgggaggcagacgttgcagtgagctgagatcgcgccactgcactccactccagcctgggtgacaaagcaagactccatctgaaaaaaaaaaaaaaagagagagagagaaaaaaagaaaaggaaagaaagagatagtattcaaggcagagaacatagaaaaatgttcccagatgatgagttgggattgtatgaagaagtgtgattaacataaaaagcagaggagtagcatgaaatattcctaggaaggtagtgtgtgttcagcctgagttggcaaaggtgaggaggtataagtggtgtgctacaaagtatatcaccctgaaaactgactccaccatgaagaaagtataggagggaaggggtgtggggcagggagtatatatatgaagtctgtatacataaccaggtttctaacataattattttaatttctagtaaatgggtatctagcacccttctttttgtttttctgttcctttaagcattctgatgggtagacagattctttgtagccaagagaaattttgtaagggaaggtggaaaaaatatgtaaaagagaaagaggaggagaatctaattctctgaactgaacattagcctagaagtgaagggtgctgacattgaaaccagattccctaggtttgtgccccacacttccattcactggcttgcaagtttacacaagatgtttaaactttttgttccttattttactaaacagtaaaatgatgataacgttagtcccatctcatagggctgaatattgagaccaaatatgtaaaattcttagaaaagttcctagtacatagtaagtgctgctgaataaatggtagctattgttattctaatgaggaagaaggaactcaggcaaccaatacatcaattttagggtgagaggaggaagaagaaactgaataaaaatctgattttcttggatacatttagtattaaacagtgctcatcaaactgtactacttcataccaagatgaaccacaagctccctggatacgtgattatttaagaaaagaaaacccttggttctgttagaactgagtttctcaactgtgacactatggacgtttgttgggaaagaaaggcagatgtcctgtgcatggaaggatatttaatagcatctctggcctctatctatgacatgccagtagcctctccttccctcagtcatcacaaccaaaaatgtttccagacagttttgttccccagatgtcactggggaacaaaatcacccccactcaagaactactgtgttagaataatcagatggaaacccattgcttgagtttttcaaacacaagaatgtagccaaaatcaatactggtacctttagcctacacccactcaaataaaccagacagctttcatcacaatggacctcactgagcagaaaccacccatcccatatgccagtgtcaaaggaaggtaagtggtagaatgcagaggtaccaacagggaggaggaattggaaatgcgttggtgacttagcaagatttgaatagtggtattttctaagcaaccagaatcgcctgagtaatataatcacctctgtgcttctgtagaatgggaaaataaaaataacaaacaagaaagggttgctttaatctgtatctcatgtgaatccattagacacttgctgcttcttgcttttcctgggatgatttgctttttaaagcagcaggcagcatatcagacaaaaaaacatcatggcctggatggtctctgcagatgggaagcaagacctttctgactgaaggtgatctgtctctgcctagagagttaatatagccagagtttttcccatcataatgtatcaactttagaaagattaatttcagctaaatggatatatgttgtgagctctgagaacattgaaagccccatgctaagttgcagctactatgcagtaggtcttagtcatctcaggctgctgtaacaaaataccatagactgggtggcttaagcaacagacatttatttctctgagtttggagtctgggaagtccaagatcaaggtgcctgctgagtgagttcctggcacgagctgtcttcctggtttgcagagaaatgccttcttgcattctcacatggtagagagagagtaggagatttatgtctcttcttataaagggattaaaactacaatggtgggggggcaaaacatatgaccttgtctaaatctaattacatcccagagggttgacctccatataccatcacattgggtattattagggcttcaacatatgaatttgggggaagacacaaaattcagtccatagcacagtgggtactctccagtagaataaaaaaaaaaatttaagaagaaatatagtaaatgtagaaaaatacagactctgttcagcaaaaccaatgtattcaaaattctaaaactctagtgtttactgagatatttgaaataacttgccaggtgcggtggctcacacctgtaatcccagtgctttgggaggccaaggcaggtggatcacaaggtcaggagatcgagaccatcctgcctaacacagtgaaaccccatctctactaaaaatacaaaaaattagccaggcgtagtggtgggcgcctgtagtcccagttactcgagaggctgaggcaggagaatgtcgtgaacctgggaggcagagcttgcagtgagcagagatcgctccactgcactccagcctgggtgacagagcaagactccgtctcaaaaaaaaaaaaaaaaaagaaataactttagttggctataggcaaaacaaatgatttgtgaaatgacaaaacatgatacaggatttctggagaatttgacacagtacacagagaaaagttgcagaaagaataaatattctttcctgactccaaatgagaaaaggtactgctcagagataaaattaaagacaagaaaattggatatctgtttcaggaaataaaactaacattttaaatcagattattgaagtatcccccaaccttattattttaggttgatctgctaagtaaacccattgggcaaatcttatgcaggcaggtagctaaattaagtggcccaagaattcttttcaatttccaatttctttgacttataacacaattaagaaatttataatgaggtgaaaaatagaattacttagaagggatattatcatatctcatttgtatttgatttaaactgaaacctaatcactttgaaaagctttgtgctgactgagttattttctgctacgtggtggatgctctttcttatttgttcaccatggtctgcttttatttgaaatattatggtatttaataacatgtctagccataaccacagagtttcttacagcttttaatatcagcaacataactcttctactctcttgacttagcatttcaaaagtgaggttcataaaaatcctatttgtagagcaaacatctaactccaatttcatgtaccaaatttggtagccatggatttctttatctccagtgcatttgcattaacataagatgataatgttgctagcttctctaccaaataacattctagcataagccacagcaagggcaaaagcccagcaaaattcaaggatgtgacatacccagagaatgctaatattcagtgtagctgaaaaactatgtatgaatgaaaaggaatatcaaattctcgtgtaaaatacttattttgagtttgaaatacttaattgtgaccaaaaaattgtttcttttcatataaaaatagaaggacatcctggagaactgtggctgtctctggaaaaggtacttttgacttcaaaatgtcactgaagaatttgtgccagaagcctccttgaaggcacacttttgatgaaagaaaaaaggatttctggttttgaaagctctttttctcagaaaaaaaaaaaaaaaaaaccttagcagaggcacaaattgaaaaatgtacaatatatgatcattgaatctttttaaaagttagtgctaggcaagaaaagcaatggaagaatttcagacactacaggaaactcctcaaattcatatttccctcttactggccttgaaacttgaaaatgaatgcagatttatgtgtccccacccatcaagttcacacgttgaagccccagtacccaatgtgatggtatttggaggtcaagcctctgagaggtaattagttttaaacacggtcatgtgggtgcccccctgacacacaccactgtgggattagtgcccttgtaggaacagacacaagagaaatctctctgcaccagagagagatccctcaccaggaactgaatcagtcttactttgagcttggaattcccagactccaaactgagagaaataaacgtctgttgcttaagccacccagtctatagcattttgttatagcagcctgtgctaagacatactgcaaactagtagacagctaggaaagctgatagttatattaactttattatttactgttcttccgtttcacattgtttgtggcagatgaagcttgcagaacagttggagcaataaagcagcccaggtatttgtggtgttccttgacccacaggctggggcagccacccagcagaagtggaacaatagagctgttgcccctcctagagaagctgctgaaagccggggagaaacactcaaagcttcacccctcctccttcagtccagtctcctgccagtgtctcccatcagaaaccagctggcaaggcagccaggaaaacacagactgcaaggatcagcctcttagcatacaggacacagcacagggagggcaagaaacatattcaagagcaaacaaatgacaggcacaccttgaaaatagtggtcaagagacaaaagtgcttctactggtacaaaagtactctgtgtgctctctctctctctctctctctgtgtgtgtgtgtgtgtgtgtgtgtgtgtgttttcttagaagttactttgttttgttttgttttgagatatgatcattactatttaatatgatcttctcaagaagcccggtaatattggacacttccttctaaagcagtgatagaaggatactggtatacttcaagaatggatggtaatatatgcatgagatatatcttttagttcatgtattgctcttaggcatcagttgtagcttgcctcactgtgtcacccaggctggagtatagtggcatgatttccactcactgcaacccccacctccgaggttcaagcgattctcctgcctcagcctcctcagtaactgggactacaggcatgcatcaccatgcccagctattttttgtatgtttagtagagacggggtttcgccatgttggccaggctggtctcgaactcctgacttcaagtgatccacccgccttggcatcccaaagtgctgggattacaggcatgagccaccgtgcccagccccttattcactcattttaatggtgcacttctgaaatttgctcccaccaaaacggcacaaccatggccttgtcagcctccaaggaatgtggtgtgaacatggatcattctaaccatacggaggcacagtaagaccaggacttaatttgagcctctgaactgagcatagggtttaatgaaccacttctccactgtgataaagtatactagcaaaactgctatggtttgtatgcacagcctgcagctgaacccattacaggatgcattatttgataggaggtctgaaagactgaagagcaattactctctacaaccaagggcaaatggcaactgtggagcttggccttttctcatttcttggtttcctgaggtcagagttctctacaatgacaaaacctctttgctctggctcatttgaaaagcaatgtcattttaaaggttagattttgcgtgtgtgtgtatgtgtgtgtatgtgtgtgtgtgtctgtgtgtgtaagatagagagaggattttatagtgatttttatgacaatcaattaaaaaaatgctttggaaacatttattgagaggggtcacaaaggtaaatgtcgtgttgaaaggaaacagatagttctggctcttccaaatctgttttaccagaacccaaggcctaggaaagggacaacagtcctcgatgaagtccattactgggccctgagaataatctttccttaccttcctgcatatcattttcctttcctcctctctcccctcccctttccccaagatacagagctggctgggaggccagcttaaccatgtcccaccccctttctctcactttgccccaggacagtcagagctaaactcacaaaggtgaagcactgatacaggccccaggaccaatccccagacccaccctccctccactgcaccacaggttcccactgccattaccgagcatggtgccccctgaccagccttcactcctcagcccttctgaaagccccccagctcttcaccccagagaccccagccccattcaagtacccatggtcctctgcttcagtctaggcattttcctgacatggaggctcaagctcacttatgaatatttaaagactcatgatttttttaatccttgaaggctactgactttctgagcccaacatcatcaacaaatagtaagggagtcataaagaaaatgctttgctcacctttcatctttcttttgtggcaagtaagaaaaaagaaaaacaaacctacttctcacaaaacctggatgtgactgtgtgttcaggaaaaaagaaagagatgggggctggtggaggcaggagggcagatgacaaaggacacagcccaaggtcataaaagggggtggaaagagttgtataagccttcactcccacctctccacttcccagaggtccagtccctgctcctcattcctcccgatgccattcctggtgcttgttggaaaagcaggatctcaggccccaccccagacctcctgaatcagatgatctaggggtggagcacaggagtaggttttagcaaactttccaggtgattctaatgcctgctaaagttgaaaagcaacaccatatggtgcagacaccagtgtcttgtgcactgttgtttaataaacaaacacttgctaatttaagtatatttgcaaggtcttggtgtggcccagactgcaagctccctgagagcagagaccatatctttcttcatgcctgacaatgcatttgttgaagggaaatagaatcagatagtattttgcttttgtttttgttttccactttaaccttttctaattaaaagtttcaaaacagcaaggaaaatcacagtgagtgttgtttagagaatggttttgagataatatatcaataccatgtgaataattaataacatcagtttaccagtaatattaataccttccagtcatatagtggctctgtggttttgaaaactcttccatgaacatttttcatttgatcctcaagaaattttggcaggaaaatgtataggtttctttctttcctctcatagaagaggaagcagaagttcagaaaagctgagaaaatagtcttggttttcctaattaggtacaaaaactggaacccaggactttgagctcctactccattggaaaggtttgtattccagttctgttatatgttatcggattgtttctagtaacttacccttgtaagtctttattttgcagtttcttcatctgcaaaatgggaaaacaatggttcctattttaaaaggttgttgtaagaattaaatgaaatgataaaggtaaagcactcagcatagggctggcacaaagatttctttattgttatatgtctgaatttacatattattcatacaatcattatatatttatgattattgcaccacactgactcccactagagtgaccaatattccatacatggtttagcaaggctggggtcttcctcgtttcagaaggtgttccttgctaacttaacaggacatttaggcctccagtctgcctttcatgccaggagtgtttctcactgctgctccccaatggatctttatgcacgctgcaggttgggtatcttctgtggtcacagtgcttaccaccctttctcatagacaggttgcctagtcattccaagcacatgccttccttagccattgtattgttaagttgttatggttaatttatatttatatttatatatatatatatatatatatatatatatatatatatatacacacacacacacacatatacatatggtagaaccacagcttttatccaaatataaaataaacacatgtcaaagatattatttaattctggacttaaagaagggaccagtaagatgttgcataggctcaaggggatattcagtgaatgcacacatacaggcaatcaggaatgcagaaatgaatttaccaagttacaaaatgggttaacacccatggagcaagaatcagatgcatgccaccaaacacaatttattggcatttctttctatttgcaagaacttgtattattattggttttccaccacctacagagctataaaatagctcaaagatgacaaaagcagagataacctggaaagctgtgctgaacagggcccccagtcatcttttctgcccactttgaagtctttcgcaatctttcctgacagtgggatctcaaaagagtagtttagtgttggaggaagagaaggtatcactatatccagttccctgcctagaaaagaggcttcacagtcctggtcttcaaaaggcccgagcgagttttcttctttggttctcttcttctcttaataccctcttccccttttcctgaagatttcatctcaaagttctacaaaatccacaaactcaaagtcccactccttctccttggaaatcccaactctcccataggactcccttggtcctgtcttaatatctcacaaacctcggtgttcaggctttggctgaatgtctgtgaagcttcttttctcagccaccaggaatacaaagtgggaagagaaggttctggtacctaagtgagggcaagtaagtactgggttctaagtttagcttccccttcaacaagcctgattgccttcccactaacctaagaaggaagcatatcttgccaaagatcactaattcccccaggacaatataaatcttgtctaatttgagagaaggatatttatttctaacaacatgactttggccttgccctgtgaaagcataacccagtcattcttgagctgaggaacgtcttaccttttcctaggtcagactttcattcctctccctttgttgtccagaagggtggtccttgcttcatctagttactgttgtttttcttccttgcatagaagaaaagaaatgtccagttgtttctaccacacatgtggtttaaaaaatagaatttgacattttataaaattaggagatcagaagttgtaagacaggcatgatggaaataggtctaagtttagatttagactaagggagaattggatgtggtgcaaggtagttccaggactaggtggatcaagaacactgcttcttgagctctcgaaatatgttctcagtactggctctctgcaacagacttaccacagagaggtggatcaaacagatccttccagaacatccagttctgcttgcttccacatgcagctgaattgacactcctagatctatgcatattgaagcatttttggtttttccaggagatatattattttctactttaaaagataatcaagcatatgaatttcttaccaagttccacattcaacacaatgtaggcactttccctcctgtgcaagcagacagcacattgaagacaagcattcacaggagccttgggatatagacccacactggccacaaagtagttgagctatctcaggcactcacatttggagtttcagctttgtcatctccaaaatgaaggtgctggactggggttcttcaaagcagctcttccacaatgtcaaagtgctaagtaactcctaagatatcctcatcctatctgtctgtgctagatcagaaaggaaaatgtgacttctccagcctggggatgaatagccagtcacacagatgtcctttgcagactgtgatggggtgaacacttgccttcccttactgcagacagtgtcagggtataaaaggttctgtggaagaagctgccagcaacacaccctaaaagggatgcattggggcactggcatcacataagatggtaatttattttgtgcttatattctgagtcaggcatttttgccgtattcagtttgtcattcactcattcattcaatctctaattctacattactgtttgagtaccttctatgtgccatatattttgctgaattctggagacttaatgatgaacacacagttgaggtctctgtcctcatggtacctatagtcaaggggggatgtgaataagtgaaaaagttatagtgagtgatgtacaaggcatatgtgggcctgcatgagtggcaactaacccagaggaagatggaagagactaagagggcctgacacagaagccataaatgtgttttagacagatggtacatgtgatggctacaggtgatttcttgcaaaactaatgaagcttaagtttagtggtgtacccataaactggctctttgaaaaaaggatgaaattatttaataatcagtgcttttgagccatactgccagctccagaacacagctaaactttgggccccttactaagacaaatcccctcttagtgtcttagtaattcccctagagcaggctctgagacaggagtttgcgcataagtagtttatgtgggaagtgaaagaaatacccatagcaagagggtaagtgggctgtgaaaggcaagacagccaataaaaggtctgtgttcaagccacctaccattatgggttaccagagcttaatctttctttaaaattctgagaatcagtatggtaacaacctgaggagaaagggagctggggtatctatactccaacttctgtcagtcattggctcaggtctgctcctgagtgtgttattttcctttcatattttaccttccctgacagggggagtgaccttccgttgctttcacgaaagctgtaaagcaaagagatgcagatactgacagttggaagtcagccaacaagcacagaagtggtaaggcctgggggatatagacagtatctggtacagattatcccatacttaattatgtatttgtaatttgcgttttacttaaattgggccctcaaatttttatgaattttagacctcacaaaacctgaaaccacctatagtgacaggcctaacttgctgaaaatacagagtgtatgggaaaatcaaagaaatttaaaagcccgtatcagaattggaaggaagacggagggtagcaagagatgaaactagaagctagaaagttgaagctagaagctagaaaggtaagccaaggccctatgaagggtgctatgttaaactgggcttttctagatttggctgacatttgttggtgtctgcagaactcagctgggttccttggggcatctcatttctgggacaaactgacagagcaacccctttctgggatgggctcttcccaagatgaagaataagaacccaagagggctgatggaagctcaccatgcctctgatgtctgttaatcacagcagcacaggtcaaatctccttatattccattggccagatccaaagttagtagggcaaggtacacctgcagggaaggacataatgactaagtaagaactgtaatacagcctactactggattttcaccaaaatgttaatagtggagatagcgagatttctgatcatttttcctttagcttttcactattgttagaatttgtaataagaatgtagcaattgtaccaaaaaatatgaacctattcttctaaataataaaagattatatcaaatattgaagagcatttttaaggatatctttttaaatttttccttttttaatgtgttatttataaatgaattaatatacatataaaaggcctaccccctaaacttcctaaaactacctattagcatttatagcatgtgtaactaatcagactttattatgttcctgtttctggtttcttagtattactctcattaaatttttttattttgtatatgtctttgtaaatcacctggaagtactttgtgatgttagctaggaaataaagaaatagattatttagaaactagaaagaaaagtagttggagggaatcatcctaataatacgcagccctgatagcatatacaaatcacctggagatttctttttaatacctctgatggagactctagaggttctaatttaatgtttctgaattgggctaatttttaaaagctctctgaaggttgagaaaaattgaataaataaatgattaaattaagtgaaaaaaataacaaaagggccaattatatgtgaagagcaaaagcaggttgggaagtttctttacaaacttgaagtaggctgtgatactaaaaagccaaagctcccaaatattaaaaagaataagggaaatggatgcagtagagcaatattagcttccagaattagaaagggcctgctattaagatctgttcgagcttcgctgggtgaggaagagtgagtcatattctctctgatacctcatattcccacatacatcccaaatcagaccctaatcgacaattgtttttgtgggtcactgaggtgcattttgtggactgtttttcagaacattgtgattaagcaaaagtctgtcattctccatgagaagaggctgaactcataggcgattacttacacacccagaacaggagagaaggaatactagaaatattgtagaaatgtggtttgttcacttgtttatagctcttcagacttaaattattttattctgtgcagagttcagttgtttatgtgtgaaacatcataaaatatcaaaagctcttttatcttgatgtctcatcccagcttttttgagactcctctttaatatttgataagaaccaaaatagggataaattatgctttcctcctctttcttttttacgtttatacataaatgttgagagaaagcttgaggtatttgttttgttttgttttgttttagctaaatggcaagtaaataacaggctttttagtaactatgatctggcactggtaaggtctgagttaactgccatttgcagagtaaccatggtgaccagcatatggcttctgattccattaatcttgttgagattaacagtaaatcccaaaggatcttttgcagtgattcagaaataaatcatcttttcacatgtatactgtttggtgacagccactcgctttcagtgtgtgtctctacccaacaaagaaataagacagtctctctcatgagatgattggaaatgtgtccctcaaataagaaatttcacaaaatacatccaatggtgaaaaggtaaatacatataaataccatgtgaaaggaggatttattcaacaaacatttgtcatacccctgatagacacataaggggaaggtcatttactcccagttaaaaatttatttgtatagaacctcagcctggagatatggaatggaaacaaaatttgagactctttaatgaaaaaaatccaattattatttcaattataggaattagaaatgatgaattaagctggatttgggaagaggagcagctggctgcccaagaggagactaataatgtgttctatgtgtaacgagatgttgcaacttaaaaagtacagtgtggccctacctaaaaccatatttggcctacaacagccccagagcatgtaaaataatagcctcattttacagatgaagatactgaactaaacaattcagagtgacttccccatactcactaagtattagagctttctcaaactggcggaataaattgttgagtctgagttggaagggatgggaactgaattactatcccagcattcttctgatgctaattcctattacagtgtagacaaaatatgcataactgtgggtctttctcaactcatggagtttatacttcctcatctctaagttttccttggttaaaggaatactccgagctcttatttcaacctagaccttcctacataaaagaaatatcaagaacacaatagcattttacgaattctaagatgcacaatttttcttacttacccatctacggctgggcacggtggcttgcgcctgtaatcccaacactttgggaggccgaggcaggcagatcacttaaggtcaggagttcaagaccagcctagccaacatggtgaaatcctgtctctacttaaaaaaaataaaaaaattagcggggtgttgtggtgcatgcctgtaatcctacctactggggaggctgtggcgtgagaattgcttgaaactggaaggcgaaggttgcagtgagccactgtactccaacctgggcaacacagcaagactccacctcaaaaaaaactgtgacattgagatatgccttttcatcaatggcttcttatgatcactatgcagcaagaccaaatgtagatttcattgctcgtacatgcactaacttggtcatagctgcttatattgccaaagtcatacagttattggtacgtgcatagaaagttattgtgtatgcagaaagaggtataaatttcattttagtgacatgaatactcattttggagtaatgaccatcattttacattttcttgcaaagcaacaacatagtgttctacaggacctaagaagggaagatacaaacagatcttgtatgttaacctaccatgcactaagcactgaaacttaaaaaaaaaaaaaagctaaatctttcagaatgcatgaaaggaatttcaaagcaacaagaagctgacataatttaatttgctacatccttttgttcttggccattgtaaaatagttttgatcctatcatttatattaggttttatgataggtggtaattcacaaatcacccaacatggcattgatctcctcttgctgatggtgggactgtgcctaaagctcccttccctgctctgctggtgcagaacaacatcaggaagtccaagtagtcaaaaccaaagccaaacattgaacatttgcaaccccaatttcaatcataaaattaaccaactctaatggcaaatcagtcttttgttcatcgtagcacaaatgctctagaccacaatttttatttcattaaaaagaaaactggtctcctttggctctctaagatttcaaaataacgattctttgtaattccctagcaattgtagaaaatattcattttacattatttcccgacaatttagaacatttgaggttacattgaaatatttcttatataagagcaaatgaagaggatggatctcatataatcatggccaaataagtatattcttcttggtcatatatttttataaatcattgaggagcagggaatgttgtatgtgcataaatgtataacctattacagcagcctgagaccccatgggttattattatgtcagcagaactgagatactcggatgtgtttagtggtagaagcaagcattccattaatttggttaagggacatgaatcagctagtaggttgtgagttatgtaccttcctgaccttcacaaaaggacaccctgacttgggtttatacagtcaggggtgcagtaggatgtactggcccaggtcagaagagtgccaaatttcctcaaggactcatttgtcctcaggaaactcagaagctgggtcattaacaccctggccccaggtccttccttacacaactgtgacactctctggtgaaccccttgtcactaatctcactctgggtatctgatttctagctttactaccaggatgagaactttttctgttaacataagtgttctctacccagggcctttccaagcccctggcttacaagacctataggaacaagagatcatttcttttaattacatgaagaaatctgatcggatgtgagatcctttaaaagaaacttttgacttcgtttgtaaaaatatattagcatttgttacttaaagtgtttccaagagtggaatttattttacaccctaattcattatgaatgcatcatttttcatattctgtgtacataagattaagtgaggaaaaagaatagagtttagaagttctgtctttatttctccagtcctgccaaatctcactgttgctaagggaatatattattaacttaggtatcagaattagaaaggtcgtattgttctgataaaatatgctatgactctgagatgtccaggtggaatcaagaatatatttccccagataatttaatctcatttgaaaacttagatgtacttggttcaggggaatatgctgaaataaaaccctatctgcctcttcactctttcctttcttctcaggaaggagaaacagtgatcatagctcattgaaaactctcctgctgtagtttaaaaagctataatatttgctttttattccctcttcaagttgagaacagctcattgccactttctattcaatgatccttcacttgactattgtttgtaacaccattcccaagctttactttttgacatgttacaaatctgttttttttcaaactttaatcatttgtttacgtttcaacatttcaatatttctctcctgaccaccaccaggtaatatgtctttcccacctatcttagactgttcttaaataaaaatgtggctgatataaagggagaattaaaaaacatagcttcctctcagcttcctgtagataacaataaatgcactagaacttcagtttttgaacttttaatgagtatcatggaaatatgttttaaagcacaggcttgagagccatactgccagaacgtgactcccacatttgccactttactggctgagtgatcttgggcaattaaccactctatgcctcattttcctcaactgtaaaatgggcataataatattctccttaagttattctaaggattaaattaatgcaacagatattaagtgtttagaaaaatacctgcgctttttctctgcctggcattgctgggcctgcaggtctgtgtcaagccatggatgagggtctttgttctgcagaatggggtttgttaaagttgttaagaatgaggcctatttaagagataccaagtgaaatttaggaaatgacaagagggtagaactgattactatactcagaaacactctgtgatacaggataaaaataaatacaacacactcaaatacagggtgatagtctgtgtaacaaacagagatatgatttgtcagattacttatgcccatatagaaggggatacggtagtctgcgcagcatatgtacatggtacatgaactaccaaaataaggtgtgaaggttggcctgacaaattatgctgcagcacattatactggcctgccactggcccacgggcttctcggtaggtttggcatggacaggatctatgaaggccaagtggagatgactggagattaatgtgatgtggaaagcattgatggtcagcctggtgccttcacctgctatttggatgtaggccttgccagaaccatcactggcaataaagtttttggggccttgaagggagctgttgataaaggctgttctgtccctcacagtaccagatgattccctgcttgtgattctgaaagcaaggaatttaatgcagaagcgcatgggaaacacatcatgggtcagaatgatgcagattacatgcattacctaatggaagcagatgaagatgcttacaagaaacggttctttccgttcataaagaacagcgaaacttcagacctgatggaggagatatacaataaagctcatattggctgggcacggtggctcacagtcccagcactttgggaggctgaggtgggtggattgcttgagcccaggagttcgagaccagcctggacaacatggcaaaaccctgtttctgcaaaaacaatttataaaaattacccaggcatggtggtgtgcacctgttgttccagctactcagggggctgaggcgggacgattgcttgagcccaggaggtcgaggctgcagtgagccaagatcatgccactgcactccagcctgggtgacagagcgagaccttatctcaaataaataaataaataaaacaaaaaagctcatgttgctatacaagagaatccaaactatgagaagcccaagaaagaagttaaaaacagcaggtggaaacatcccaaaatgtcccatgcccagaagaaagatcaggtagctcaaaagaagggaagcttcctcagacctcaggagcaggctctgagagctaaaacaatgttctaggatgatttttcagacaaaaacaataaactttttttattttattattattacacttagttacatatgtatacatgtgccatgctggtgtgctgcacccattaactcgtcatttagcattaggtatatctcctaatgctatccctcccccaccccccaccccacaacagtccctagagtgtgatgttccccttcctgtgtccatgtgttctcattgttcaattcccacctgtgagtgagaacatgcggtgtttggttttttgtccttgcaatagtttactgagaatgatgatttccaatttcatccatgtccctacagaggacatgaactcatcattttttatggctgcatagtattccatggtgtatatgtgccacattttcttaatccagtctatcattgttggacatttgggttggttccaagtctttgctattgtgaatagtgtcgcaataaacatacgtgtgcgtgtgtctttatagcagcatgatttatagtcctttgggtatataccctgcaaaaacaataaacttattggctaagcaggtttaaaaaaaaaataccctgcagaagcaaattattacatttattatctaagttccaaaatcaaaagttggttaatttgtgtcatgaatcatactggaggcttattctaaattctaaatatcctgtttatagcaacttaaaatgccagctcattgtattataattttgacattaatcaacctgacatttttcttttataaaggtaaggcatgaacatattagctctcatgattctttttttaaaaaattattacttctcccagatttcctaagccccatttctttagctctttaagttgttactgtgataagggaaaatattgttttcgtgtgatgtgctgtaaataggttgggcagccatctcagtttgcctgaaacggaggggtttctcaggacatgggactgttactgcttaaactgggaaagtcttggggaaaccaggatggttggctatcctactgtaaagctattacataaggtggggtaaaagaggaaaggaagaatcagtagtggtattaatctcattaaatacaaaagaattattagtacaccactgttcccttgatttttgactcatgcaatctctgatgagtatctgaagggtaaaattgcactcaactaattaactctaaatgtcaggcatttggacatcgtgttttttttttccttttgctaccatcatcatctgtggaatgtatttcttctccttcattttatgctgttctgctttcctctgattgtgtcatgcttcttctttttcttttaggtcaactcaaatcaaaacatactcttgggacaatgcccaagttattctggttgggaacaagtgtgacatggaagacgagcgggtcatctcaactgagcgaggtcaacatttaggagaacagcttggtaagaaacaaattaataagttaaaaagaaagataatttgcttattatatgtaactctgtacagagtccgagctaattgtcagggtggagttaatgaaatgtttgtcaatctaagagtggaaagcaacataatcctccctaagtggacaatatattttctcccacttactatggcatcatgagagctcaagcgcaattacagaagcaaaaatgatactcagaattttggtcttagtacaaggtatttaaattcttattccatgagaaacacaggttatgccttgtccgttatttttggtttttttcccccatactctattttgcattcagtgagctctttattttattgtgtgattattgttctcaagtttccattggaggaggataatggcacagaataggtcacatcctagattctgattctagtgacatcactgataagccatgttactgttacaaatccttttgagacttagtcaccccatctctccagaatgagtatcatagcccgtgcctatttaaccaagtccttgtagataagatcaaatgagataatagatatgagaaagtttcagaaatggcaaagccatttcaaacacaaaacattgtatctaaagagaaaaatgctggagtgagaagggtagagatttaatacaaaggagggattgatgattgatgattgattgattgagccaagaaatttttactgggtactcgttgtatgctttatattatgccaaacatcatggggtatacaaaaaagtaattcacagtccctaggctcaagttgctcccaatcgagtggacactgaagactggagatatacataaggaagcagaaatacaagtcaacaaaaacaggtcaatgaggagataagctgcaaggcagatgccaacaggaaagcaacagggagagggaggcagacacaggaaggggaaaaacattgccggaaggagatgtaggagtggagtgtgatgggaggaagataaagagcaatgcagagagggcccccggggagatcaggtgtggaaatgaatacaccaagaggaagagatgagtgatgaggggagatggagatcatatgggtgaaatggcaagatacagcttgaatggtctctgaaggagagtagaatttgcaactacaaaggagatgaggcattatgagtaaagggcacagtcatgcatggacattgagatgagcataaggtgagaggacagtgaatagaaaagtgagaacctagcagaaagttgcagaactgagttgtggatttggggaacaactccagtcctagaggtgaaggagttggaattctttttgttttttgtttgtttttggtagaccactgagaatattgaggcattcttagcaaagaagagtttgacttttaacctttttggccaggacctgcagtaagaaatactttcaatttagcaacccaatacatacatatataaaacttctgtaaaacaaaagttttacaaaacacattttaactttacttgatgagattcactctgttttctgtcttacttttctttcttcttttttcttaaatggtggtcccaacccactaagttgatccccagaagcagtaatgtgtctcaatctataatttgaaaaacactgttataaaggggatgatttgggattaatctgctggtgttgtgcaacatgagtcagaaaagcaaagtccctctcattgggtcactcttcctcttgatcatctcataactaatctaaatacagttcactctgaaagtttgaccatttctcatgagcttaatgagttccttagactaaaatctatccctggatggccacaagaacccttccaccaaatattcttagagccacccaggagaaagttacctggctggtgtacggtctcctgtggcagcttttgaagttaccatctctgccacagggcctcttcccactctaccgattaaacaatatgaagagtctgaaaaaatgataattttttttcttaatcctcttaggacctcagaaagataagaatgggaaataatagatccccaaagaaagagagggaggaaacctgggagagggttggcaggttggcttcccaagatggtctcttccctgtcttcctgtgttttcttaactagctgggcacatgccaggatggggaagaaactgctacacagatgtaggctgtctctatgaataaaaatgaaaactgtttggttaaaaaatatatatatgtatctccaagccaagaattgtttaatgtcattgatacataggaggcaggcaactggctaaattttttaacactctaataaattacttggatattgagaagaccaggttgtgaaaagggatgttaggatgatggaaatgcatcaatagggtgactttcccactgctccatcgactggcacacacacaaaccctttccattcagtagacagatgtagcaaagttcctgaaattgtgaagcagaatgttttatgttcctgttcaagttcttccagtggtttctaattgattttttgctctctattcaataaaaacccagctgttgtcatagcaaccaacacatgtgcattcttggagagtcatttacctcgtttaatgtggcttgttctcctcatggctacacatgcttctacaaatgatcctgagggacaatttgtatttttaaaaaatgctctcacaatttaaatttaaagattttaaaggtctttgctttgttttttaattacttgtacattttattcttcagaataccatcacatacacacaaaagttgcacattgttttttaaaagtcattaccacatcttggcagatggctcgaaataactgctttatcgatctggtagcaattaattctccattgtggattgttttttctgtacaacatttgctcatcctaatgagggtccttgatggaaccaagttgtaatggagctctttaaaaattcttgtatggcagctgtcggtcgcaatccagtttagttcatcaagcatttattaagtgtttacaatatgccagttactgggaatgcaatgacaaataaccctaccttctaggagcaaacattgtaatgcctgagatagactacacagacaaagaatatttttctggctttccctttctcagccattttgtttcatttgatcctttgagcacccctccttactgaatgctgcttcgtcagcatttatgacgtggtgctctctgttcatctcctccctctccagacttgcatttagtttccttggtagactcctcctcctttatccatctcctgcactctggctttctatcctcagtccaccactcctctctctctacaccctcccttggatgtttccatccactccaaggttttaactgcacctccagactaatgactgccaaatcatgtcccaggcctgacctcacactggcgcttcaggcgccaacatccacctgccagctgtgcatattcagtacttctgatttagagtagtggtctaatcatctgcagctgaattggctggggttcattttcaaacgcacattcatcaacccaactcagacctgctgcatcagagtttttgaagttgaaggctagactctacatttttaacaagcatttttgtgacttttatacgactaaatttccagaacactggcttttgtgggaagcgagtgtttggagagggtagggaattattgctgccagagctgaacattaccctatagctggtgttattttaccatgctttttttttttttttttttttggatggagtctcgttctgtcacccaggctggagtgcagtggcgtgatctcagctcactgcaacccctgcctcctgggttcaagcgattctcctgcctcagcctcccaagtagctgggactactggcacgtgccaccacgcccggctacttttttgtatttttagtagagatgggctttcaccgtgttagccaggatggtctcaatctcctaaccccatgatctgcccacctctgcctcccaaagtgctgagattacaggtgtgagccatggcacccggcctccatgagtgttttaacagttagtctatatgtatgtacctataacaatatataagaatgtttttaaattctatattaaatttatagtatggtacttatatatgtacaatctcataatttaagttttaaatgtacaactactgttttaaatgagaaaaaaatttggagatacaattaaagatagattttcctaaaatagaataatttatctgggaataagaacaaagaaagaaatttatagaggaggatggatttgtattgccttgaaaccacaggtgaaagaatacttgaaccattattataagctcggaaagggcagaaaatgcagaaactcctgttttccaaaaatgtagtcagagaaccaaagactgcagagaaactataattgcttctgaggagaagtcattattaataatttgtaaggagccaattttaaagcgttttcaatttgcattaatatttcttcctaaaacaagtaacagataatattcccaattctctccactcaaacaattatcttaatagcctctgaacatacgtattaccaaattccagattcatcccctgtacccttccttcttgtccagcactgaaccccatgagaatttctgaaagtacaaaatattcttatattttgccattttaccaagctctataatttttcttcccttcttttcccatttaatggctcttttgattattcatctgacaaatatctataataatactgcggagtcataaaacgtgtatcttccctctcacggagcttaaagtgtggactgtgtttcagaaatagactcaaatattatgaacacgtaaacagggctgagtgtaactcagaggataaaggaagggcatgaagttctatgaatgggtagttacttctctttttggaaaatgaagaatgacaaaaagatacattctatgtctatatactccgaaacatattgatttgataaatactggcttaattaaacaatttcttcaaggaaatagtctcttgaagtagaaagagatacatttaagacaaatgaaaaaggatattctttcacctaacaaagaatatactaatggaaccaattatctctggaagtggaaggtagtgcaggcgggacatataattacttcccaaaaggtctagataaatcaatgcaggcagatctaccatggctaatggggggagtttgcattctgtgggatatttctgtgtcaccaagcataagagtttgggtgtattgaccatgctacatcatatgttgtggtaccactctcagagacaagatgactgaagtgactgaaacattataacctagccagaaaagtggattttaagaaccatgctcttgatttctactgagcctgaatgaccccagcatgcctgatttgggaactctaagattctctgattcactcctatgaacttttcagtttaaatcacccttgtctctcactgccaacccaggtaagggagagaaaggcattgactacactgtgaaatcatacggtggtggaagccctgaacttggatccatgtgctctggccataagcaaccaatttctatttatacaatttccaccaggaaaaattgtaatagcagcatcatcataccttccataaccaccaagctccacttcagtcatcatacccttgggacaatcttgagtcacgcaataggtcttttttttttagagatgggatcttgctctgttgcccaggctggagtgcaatagtagcatgatcatagctcactgcagccttgacctcttggactcaagcaatcttcccatccaagcctcccaagcaactggaactataggcatgcaccaccatgcctggctaattcttttttattttttgagagatagggtcttcactatgtcacccaggctgatctggaactcttgggttcaagcaatcctcccactctactttagcctcccatgactggggttacagtcatgagccactgtgcctagcccacaataggacttaactgaatttagttttctatcttaaagtccaggaggaaggtagggcatatgtagctggtaaacctatttaaactccgaccttggaccccacaatctttcagtgatccacacaatccaatggaagatgctagaaaataactagatgattacaaaggataaattatcctaaatcaaccatactcaaattcataatttctcttttcaaaatgtgctcacctttctggaacttccccaactaataaactgaaaaactccttagccaagtgtgctgtgatttataagaaacctctggaaattcttggtatctcactctatgtccaaattacactgagatgattaccactaaattgtacagcaatttttcagtacctttagagcaccactttagggaagctataatcagaactacttaaggcggttctcatctgaataactaaaaaccaaggtgttagagagtgtgctattttatttgcttgtttgttacattgagactgctgatattgggaatagcagggatatcaggagtcactgctaggcctcagcacattgaggggaccttgcttatttctcaaaaaaataataataataaaataaggaaaacccaaggcggggacaaggaaacaaatctagaaggaagactagatatagagaaaggttctcgatcttggctacacatttcagtaggttgggaagcttttaaaaatcctagtgaccaagctgcatcccaagccaactaaattggaatctctgggctgggacccagacaacagtatgttttttaagtcccaggttattccaatgtgtagacatgattgagaaccactgatttacagaaaaaacaaggggcagattagcccagagagccagcagaaggaagctgtaattggttccacccttcatggtggggctcgtgctgcccggccacagggagctggtcttccaggatggattcatgctgaagctttcatgcaccctagtctagtccccatgtggccaataggtgcatggattttacagaaggctattggggatcagaagaggagtatgaggttatacaacagaacgtaattattaggaccaatgtaaatttagcaaagtccacttgtaattgcataacaaccactgagctgaaataaatgagccaaagattcttttcttaaactacagtggggtcacactaggagtttatttcttttggggggcaggagatagacacttcaaaatagaactcatgaatatattacgggactttattcatttactaatgtattcatttattcagtattattgagcaccaactattggtcaaggcactaggagttaggaaacaataagaccaaatttctgtcaccccaaaggagagtctgagagacacataaagactttcaaaagacagcatataattgttgtaatagaggcatggactcagtgctagaggagcttaaaagattaagaatgtccctgtttggaggctctgagaaaggtcacactgtggagacaatgtctgaaccatgtcttgaagtatgaataggattttgatagttagacaaacaggtgatggtctccctaggcataataaatagtattctggagggatctaagcctggaaaagttgacatcatatatcatggagaaccttgtttgaaagaatcaaaaactcgggctttgtcctatacatgctgaggatcctaagttttaaacactggagtgacaagatcagatttcattttggaccaattacactggcaatattccagaaattagggtgtttaagatcagcaggagtacaaaaggaaaatattaatagctctatttattcgtacctcaatttttttttcagttattgggtatgttttataaggtactactggaatagtacattatataatttatgaaatattcatgtattagggcagtactgttttttgaaactaagaattataaaacaacatatgtttggagaccactggctaaaggatagactggagggtaaggacaggaagcagagattccaataagaagctgatgctattgggtaaattatggcgaggcctaaagcaggggttccccaccctggctgtacattcgaaccacctaggtagcattttaaaaaccatggcacggaccccatcacacacacacacacacacacacacacacacacacacatattaagtaaatcagaatatctgaagctgaggtacaaacatgagtgtttttagctccttaggtgattctaatgtacagccatggttgagaacccttgatttaggccctcaccatgtctcacccaattgtgttaaagttgaggaccacagacctaaaccaagcagtggcactggggatacaaacaaggaattagaggcataaaagatgatggaggtacctggcctgagtaacagattaaaatcattgtggagggagaatttcggagtaaaatcaacacactaacaggcagaagggaagacatccagaaaagtcagagagtagagagtcaggatagtggagatacttaggtggtcagtcatgaaggcaaatgggacaagatctagaaaatacattgaaagaactagtcttaaatctaagcaatgcaatccataattttaaatatgacagtaaattactatttaaatgctttgataagcattgatccacaaatgatccatgaggtgatacacataggaggacagtgggaatttggaggctctttaggaagaaaaagacaacattgcatattgcatagagaggtgaccacccctttctttttaatgaaatcgaaatagatttctaagagttgccttcattcaatgtctttttgataacacaagaaattagttcaaaaaagtaaataacatcattaagaactggccattgtagctacctatgtctgcattgttaaccttctttttagcaaaagaccatggctgatttaatggtttggtggttcacacacatttatagctaatttcatgtcatagatttcagcctatcgttacagtttcagtccagcttgccaaggatcatttagtaagctgggcaccaaagccagagaaacatggacagccctagtggtgggcatgcacccaccttggctatcttaaagcttttctgttgagctcagacctgcaatgttgcctccagccacttcactttaatgaaggatgatggttttttccttcagttttaatcctttccctcttacccctgcaaaaacaattatgtaataaagccaggttgtgcagccagaaactctaatgaggttaacattgccctaaagcctatttttaaaactcaaaccacctgttccaaatatgcattagctctgttcttcagcagcttttaaagatttatttaactctcaattgaagtatttctcaaagaatgaaaattgccaacctctgggttcagcagggaatcccagtgatgctactaaaatgttctaagtacctatctgcacacacctctgaggagaagcactgccaccctaccattatatccccaggctcactttctttttggctaagtattcccaggaggtataaactaaaccaacattgtacattttaatgtgtttgggttggtttaggtgtggtcatatccatgggctgggaagggaagggactgctgtttgtttgccctggttcttgtctcttttgtgcttcccagttcctgttaacctgatctttatttcataatcttatggatctccactctcccttctggcagctgaaattcactcctcagaaactgtctgttccttatgaataaagtgaccatgcatcccagtttgctcaggacagtcctgtttatgttcatttcccagtgtaagtattaatagcatcccctttcaatctcaaaagtgactcagtttggagaacaaatggtatggttatccaatccatgaaaccccacccatgcagcatctttgagtgataaactccacttcctctttgttttttatgctgcccttcttctaaacctctacttattttttctcacattccccagtgaataaactctcaagactctggcaaatccctattttactgagactctggcacatcgctattttactaattgccttccttaaccaactccactaatctaggtgttctttcctatactccttcttactaatccagatcttaccaacctttgacccctgagtttccccattctcatgattctgacagctccaagggacatcaatatgcaaagtgcccttcttcattatgaagagcttccaaagccccactgtctatctgttacttgtggatcaaagcttatcctctaacaaacgttatgtttacatgtctcctgtcccatctcgacagacaaaattgtctagccctcatttttctacctggatttggctcagaacttcacctttgctccttctcttagaatgatcttccaagctgtgcccttttctcattcacacaaacttgcaaacacatttggtgaaatgtttaaaaattaatccaggtccatgtaaccgaaatctgtataaactgccagcttcattttttatttgtttttcttttttaacaaaaaaaagcataaatagcagtattacttaccaaaattaaagtcagatataagaaatataaactgcagtatttggatttggatttaattaatctgctaagtgttgagagctgaaaaagattaaatcaaggatggctttctcacactaaattgtggaatctgtgcttggatgcagctggcagaaaccatctctgttcatcagctttgcacactggccagtgttatttcctttctcccagggtaaaattattagggcggggaacagtagagaaacaaatcacactaaccaaactcacaggggacagatttctaatttaaaatgccttttatcatgctctgcgaaatgtaaatgtcacacagttggtaatattcctgttagacaatcagtgtatccttttatcaatagaaaaaatacccttagaaaggctatcaatttattatggtttcttagtggttctagatcaaagaaaagggaatccaatgatgttcactcatatatttctttatttttaaaattaaattaattttttttacaaattatgatgtttcatattcatagaatacatagtgaatttttgatacatataatgtattgtggtcagatcagggtaattaacatacatttatcatttctgtgttgggaacgttcagtattctccttctcgctatttgaaactatacaatgtattattgttaactacagttatcctacagtggtacagaacactagaacttacatcccttatctggctgtaattttgtatcctttaacaaatacttccttgtgcctcccttcccccacacccttctcaatgtctagtatcttctgactactttttactactataagatcaactttttttagcttccccatgtgattgaaaatatgcactgcttaactttctgttcctggcttttttcacttaatataacgtccctccagttctacccatattgctgtgaatgacaggctttcatttttttatagttgggcatatttcattgtgtatatacaccacattttttaatctattcatctgtttttggacacttaggttgattccatatcttggcaattgtgagtatgctgcaataagcacgggggtgcagatgtctctttgatatactgattttcttttatttgaataaatgctaagtagtgagtttgttagagcctatggtagttctatttccagtttttttgagacaccttcatactgttctccatagtggttatactagtttacattcttaccaacagtgtataagagttttcttttctctgcatcctcaccaacatttgttattttttgtgttttgataatagccatcctaactacggtgagatagatgatacctcactgtggttttgattcacatttctctgatgattggtgatgttgaacattttttgatacattcactggccatttttatgtcttttttctttttttcttgaggcagagtcttactctgtcacccaggctggagtggagtgggtgtgatatcggctcactgcagcctctgcctcccaggttcaagcaattctccagcctcagtctcccaagtagctgggattacaggcgtgcaccatcactcctggctaatttttatatttttagtagagatggggttttgccatgtttgccaggctggtctcgaactcctgacctcaagtgacccgcccctcttggcctcccaaagtgctgggattacaggcatgagccaccgtgcccagccatttttatgtcttcttttgagaaatgcctgttattggtctgatcgagttttctatttcttcttgtttcagtctctctttttttttttttttttttgaaacaaggtcttactctgtcacccaggctggagtgcagtggcacaatgtaggatcactgcaacctccacctccaaggttcaagtgattcttctgccttagcctcccaagtagctggaagtacaggtgcccaccaccacacccagataatttttaagtatttagtagagatggggtatcaccatgctggccaggctgatctcgaactcctgaactcaagtgatccacccaccttggcttcccaaagtgctgggattacaggcatgagtgaccacacccagccttggttcaatctttgttggttgtatgtgtgcaggaattcattcatttcctctagttcttcaaatgtattggcatatagttgtccatagtagtctcttatgatcctttatatttctgtggtatacattttgatgtctcctttttgtctctgactttatttatttaggtcttatctcgttttttcttcgtctagctaatgatttgccaattttgcttattgtgttataaaaacaactttttggccaggtgcggtgggctcacgcctgtaatcccagtactttgggaggccaaggcaggcagatcacgaggtcagtagaccgagaccatcctggttaacacagtgaaaccccgtctctactaaaaatacaaaaaattagccaggcgtggtggcgggcgcctgtagtcccagctactcgggaggctgaggcaggagaatggcatgaacctgggaggcagagcttgcagtgagctgagattgcaccactgcactccagcctggggacagagtgagactccctctcaaaaaaaaaaaaaaactttttgtttcattcatcttttattaatcttttattcttaatttctttcttcacccacttgtcattcagtagcatattgtttaatttccatgtatttgtgttgtttcaaatgatcttcttgttattaatatctaattttgttttattgtggtcaggtaagatacttaatataattttagtttttaaaaatttgttaagacttgttttgtgttctaatatatggtcaatcctggagaatgttctacatgctgatgaaaaaaatatgtattctgcagctgttgtgtgagatgttctatcaatgtctgttaggtccatctggtttgtggcatagtttaaatctgatgtttctttgttaatttcctgtctggatgacccaatgctgatggtggattgttgaaattcccaactattatattattgaactattatatcactggggtctatctttccctttacatctaatacttgctttatgtatctgggtgctgtggtgtcaggtgcatatatatttataagtgttatattattttgctgactcaatctttttattattatattgtatcctctgtctctttttatagcttttgacttgaagcatttttttttaactgctgcaagtatagctatccctgcttacttttggtttctgcttgaatggaacatctttttccaatccttcactttttgtctatgtgtgtctttacaaatgaagtgagttttttgtaggtagcatataattgggccttgatttttttttaatctattcagcctgtctatgtcttttaaatggagaatttaagccatttacattcaaggttattatttcataggtgaggaattactcctgtcattttactgattgtttcctggttgttttatatatcttttgtttcttatttcctcttttattatttatttttgtggctgggtccctatctgtaatgataagtttttattttatttatttatttatttatttatttatttattttttgagacagagttttgctgttgttgcccaggctggagtgcaatggcacaatcttggctcaccacaacatccgcctcccaggttcaagatattctcctgcctcaaactcccaagtagctaggattacaggcatgcaccaccatgcccggctaattttgtatttttagtagagatggggtttctccatgttggttaggttggtcaagaactcccaacctcaggtgatccacccgcctcggcctcccaaactgctgggattacagacatgagccactgcacccagcctgattcctttctcttttttccttcatatattgcctctactagggagttttatagtttcacaagtttttattatgtcatttatcatctttttacttccaaatgtaagacttccttgaacacttcttgtaaggccagtctggtaatgatgaatttccttggtttttgcttttatgtgaaagattttatttctccatcatttctaaaggatggctttgctgggtataatatttgtggttgggaggtttttttttttcttttggtactttaaatatattattccattccctcctgtcctataggggttctgtgagaatttcactattaatctaatgagggttactttatatgtgacttgatgctttctctgtctgctatgattttattaattatgctatcctcatcttttcccttcttttctgcttcccaaaacactgaaaatataaatatttgttcacttagtagtgtcccataagtcctgtaggctttatttatttatcttttttctttttttttctgcttatattatttcaaaagccctgtcttcaacttcagaaattcttttttcttcttggtctagtctgttgttgaagctctcaatggtaatttttttattttagtcattggattcttcagctttaaggtttctgtcttgttctttttaatgatacccatctctttgtcgaatttctcattcaaatcatgaattgtctttctgaattcattgaattgcctatattctcttgtatctcagttttcttaagtttattgttttgaattctttttctgggatttcacacattttcttatcattgaggtctgttacttgagaattgctgtttttcattgacagtgtcttgtttccttgctttctcatgtttgatgtgtccctacactgatttctatgcacgtggtaaagtcacttcttccaattttatgaagtaggtttcatatgaatgagttttagggtattggtttggtagagtacattggctttgcttctaggtggatgcaacagtgtactctccatgtagtttcttcagctataatccatactagtagcataagcaagtttctcagtggtctaggctgagagagtctgtggcaccagtggtgtggctttgtaggattggggttgctgggctgtttctcaggttggaggcatatatatgcacacagtgtgctagctaacttggagtcactggggttggagctatggtactgttactcttgccacaggcacaagcatgcaattgcttgtctgacctagaattgtgcctgccaggagtggtccgtggaactatttctcaggtctacatgcaggtgcaaggctcttcagttggcctgggggtatgcccaccaggggcaacctgcaaggctgtttcttaggcactgatggagagtacaggaccattgggtaggccacagccatgtctgcagggggcagggggcaggggcactgcagggctatttctcaggtcctgagcacggtcacatagcgactttgctggccaggggcagatcagctgctcagagactcaggtcctctcccatttaggggagggcatgtagcagtttggctggctcaagagtagagttgccctgggcaagattgctatactcttcccccagctgaaagtgtagtgacaggagttgttttccctgctgtgcaggaccagagtcatagctgattctgggcccaggctctgcacagctggggttgtggcattcagctacctgtatcagcttgttggaaataaaatggagtcccagtgctggagaggtgcagtagatactggcccccagagaagggtggaccccagaggtagctctggtctcaagatggtgctatgctgcagaagcttggctcacaggggtgtgaggtatggggagtgcaaaccttgtgctcctgctacagggcaatacagctgcatgaattcctagcggctctccaaaatgggcttagggtttgcaagagctttgggattctcctcttataaggactgtaggtgtttgtggtggcagtgggggctggtggggatcattttacattttctcttcagtggaaagtccttcctaactccaggcagatctgatccagtttggatagacaagtctgcagagattgggtgcttctacacagccctatggtgatttcaaatcaccctatgtgtgtctgcagtctcttgctgcacttagcattctccctttgacaaatcgtagctgtctgttccttgccttggtccttttctactcatgtatttcttatcctattgagctctcactatgtgccaggcatgtgatgttaagggataccattgagtaagtacaatgctctttattgggatacagagcaagtaaacctgtatactcagccaactcaatgcaggcatcctctcatttccccattgaccatactgggcagtaaataatctcaatccttgactctttttttccttgacttcacacaaatcaactccattttcttttaatggttttaccttgaaatttttatcatttattagactactgataaaagagaagtcttaccctccatctgagaaatttggaagacactctagtcccttgatggattttgagaagtgtgctgttctcaccagaaaatcgtttgttcatcctatcttggagtgaattccttctgcagatggctaatctcatggactttgtggcacttacttaataactttattctcagtggatgactttttcttgtctcaatcccaaatcccaaagatatactctctttgatgcctgtaggcacctgctttcagctgtgtacagactgacccatgatatttcatccgtgtaagccattagaatagttttctccactaaatcttggtactatgccctattgtctctattttacccttaactttacttaactggcatttgcatggcttggctttatttgacaaggaagtagccatcctaagaaagattcatcatcatctcatcctctgccttgagagttcagtgaaaaagctagctgcttctggagagagttccttttccatattcaaacttcatcaagacaagggatgatttaattacgactttcagaatttgtcactatataaagtaaaatcatttgtatgaagcttcacatagtgttctgtgtctaggctgtgttactattgaaaggaggtagatatagacctcgagaagaatttcttgattttaagaattggcagatattagtacatattagaaaggataagaaatcccaagaacttgtaaatgaagccaacagctagtggaacactgccaaaatataagaagatggacattagggatgtacaaaggttaagagtgtggactttagagtcagattttagatcttgtcctggtttaccaagtgtgtgactcaaccattttcgcaactgtaaaatgagccttgtaaagtcatctacttcatggggctggttacaggattagaaaataaatgcaaaaaggcctagcgtagtatgtgcatatagtatgtacttaataaatgttagttacatttaagattccatatcctttgatatcacaatgaaatttcattcatttgggccctagtaattaaaaatgtattacactatttgctctatttcatatgtatcctccacagcaaaaataacttcctaattgataatgcatatgttattgtaacctgaaaatcctaaacagacagaagttatcaatgtttttgttgacaattcataaataggctgagctggaaattgtctcctttatcattgaaagcctattgaaatgttaagaagttacaaggttatatttaacccatttcagagaaaaaactcttttaaaacacttagcactctttgcatataagcagccactctgccaatcataaatgatccttatctctttattaaaaccaatatgacagaacattgacttctcagcactttaatagttcttagttcaggtgttgaagtgtaacgatcttgcatttcttcaaattttttcagaaatatgtctttccttgtgagtaaatagagctggtttaatttgttttatatcataaatttcccacagggcaaaaccaaaacgatattttgtgaaattccatgcttggtaaactccatctaaaaatgatatggctgacagaattgttcactggtttagtcacgtcataactaaaaacaaaggaaaagtgattctctttctctccatttccccattaaccccactacttctcccagccaattaacagaaatctattctttaattaaccctataaatatatacacctactatatacccacaaaaatttcaaaagttaaaaaaaaccttttaattagccaacatctactggacacctgctcatgctgggcactatgttactatctctagagatatggagaagcacagtggaatgtacattctaattgcggagcaaaacacacgtagtatggaggtggtcaaggaatgaggggtgtttgcttttggatgcaaagtttctttctggggggtgatgacaatgttctgaaattagatcatggtgattaacctttgtacatccctaatgtccatcttcttatattatggaccaggatttgttaaggccatagactgaccattgcatagtttcagaattctaacagaagtaggaaaatgctaccatctggtcatgcctggctaaagacacagactcaggggctgaaataccatttttttagtagcactagcctttggttgagctcctattcttgcttttctacagctttggtctgcaattttggcccttcttcaggcaaattgatcaaaagccttacctcccacttctcttcctaaagcctgtctctgggctggggcccagtagaggacgagctaatatgccagtttgtcctgctgctcagcaatccctacttctggctcaaatgtcacccacccggtagcagaatgacctttccttgcagttctggcccatccagttccacaggaaaggggagacaagacattgcaactgtaactagaatctggaaaaagaagattttctcatttaggagcttgggaatagaaacttaagaacaaatcacagatttttaacaattggagatgaaaataatttattgcagtgtgactttagtggctatttcctctctacagaaaaaaaaatatcacttgtgatttttctttcaaagtaaagtttaaaagatcagagtgccccaagcgatgtttccctggggttaaaaaaggagcaacagtgccgcagaacatctcataaaaacaaatggcatttcacaatatggtgtagctattgatgggtggaaatgaatcaagtgtttcctgtaagattgttgtaatgcactggagaaagcgggggaagaggtggttaagtgtgcaatactgtgattgtgattattaccattaacacaatgcagtcacatgtggaatggagtcccctagggtgctctgacgttccagtactcttcaagcgccagagtgacatcctggagcctgccacctcagtgagcagcacacttctggcctaaggccctgcttgctgccctgtgggtatcaatgtgaaaaggcctcagccttctctgaggcttcctttgctctaaggacctcctgggagcaaagtggacagaagagtgtcggcaaatcaggcctgcgccacagccaggaagtgtgggttcatgttcttcacgtgcaccggaaggtattagaatgccctccttgaaaagcagctgctctttcatctccattgagaccagagcaaaaaggattagatttaaacacctgtaagaagggttcttgttgagcatgggaaccattttgtggtaggggattctgccagtcaccagaatggtttccccaatcggccatggggtttctcagaaaaatctctaagggcaacgtacattctcattcatttaggacagtgattcttactatatatatatatatatatgtgtgtgtgtgtgtgtgtatatgtatatatacatatatatacatataggtatacatatatgtatatatgtgtatatatagttttatagaggtataattcatataccataaaattcacccatttgaagtgtacaattcagtggtttttagtatgttcacaggactgtgccaccttcatcacagtcaattttggaatattttcataaccccagaaagaagccccctgcccatcagcattcactctgccttttccctcactctctaccccagcctaggaagctactaatctgcttcctgtcttatagatttacctattctgggcattttttataaaatggtctcatatgagatatggtcctttatgtcaggcttttttcacttggaatactattttcactgttcatccatgttgtagcatgaatcagtatttgtctttttgtgactagcttattacacttagcataatgtcctcaaggttcattcatgttataacgtgtgaaaatttcctttcttttaaaattgaataatattccattgtttatgtataacacattttgtttatccattcataggttgataggcacttggattagttctaccttttggctatcgtgaataatgctgctctgaacatgggtgtacagaggagggtaaatcttaaccttaaatgtgcgtaagaaacctcccaaggagcctgttaaaaatgcatattctgaagccccatacacccctcttgattcccattgttcagtatgtgtagagtggagttcagaaacttttaagcacttcaggtgatttgctctgtcacccaggctggagtgcagtgacgtgaacactgctcactgcagccttgacctcccaggctcagtggtcctcccacctcagcctcccgagtagctgggattacaggattgtggcaccacactcagctaatctttgtatattttgtagaggtggcgtcttactatgtaggccaggttggtcttgaactcctgagctcaagcgatcctcccaccgtggcctcccaaagtgctgggattacaggtgtgagctatggcacccagcccataatttaggtgattctaatgagggtgaacctccaatcctatgaagtcagggtgtagaatcacagccgtttgtcactagagtgtagtctggcttacactgcctctctctgcttgctctttcagtgtccaccatgaagaggacacaggttggcttttgcttctgctcctctttcctcagcatagctaacatgttttatcaaacaaaacctttccaagcttttatttggtccctaacatcaggtgaacctgaagggattagtgtcccgctgtacctgtagtggtttttggaaagggtaggagtgaccctttcaggatcaggcatgaggaagcctacaacagagatgtgctggaccacagtgcaaagctcatgcatctcacgaacagtgccgcctgcctctgccaaagagattagaaaggctttgttaagggaaggatgagaaagaatgatcagagtttctacagttaagtgaaaggcttcactgatttgctgatgaagaaacctacatgagctgaaaatactaattctggatgatgtagtctgagagacaggtgttcaaggctgtaagctaaatcagtaacttatttatcaggaggtctttgtcagacttcacaatcggcttgctgtgtgactttgggctacttatttgatcttgctgaaccacactcttctacccagtagattggaagtgatcttcaaagttataagactctgtttctgaagtatcattgatccagcttcccactgacgttggtgtgtacgaatgggagattaaagatttctcagaacaagctcaaaatactgagaactgatctcaaaatacagagatactgggaggtaacagccataaaatctgagttagtgaaagaacaaaggctgtagtggttgcattagtggttataacttaggccatgagctttaagcacccatgggcacacacagttgagggcatgagcatcctcatacacaggtgattgaatgaaaagactgattcgcttggatagaaaatcaagccccacttgattttctaaacatccctgtaccccaaatctaaactactaaatgctaaaatactaatgatattgattttgatcctgaatatcttattttatgacaaacttatgacaagagatcccagcatatctggtcaatgagaagcactttaatttccagaacctttatttatttatttatttgagatggagtctcgctctgtcacccaggctggagtgccagtggtgcgatctcagctcactgcaacctccacatctcaggttcaagcgattctcctggctcagcctcctgagtagctgggactacaggcacatgccacaacgcctggctaatttttgtatttttagtagaggcagggtttcgccatgttggccaggctggtctcgaactcctgacctcggtgatccacctgcctcagcctccaaaagtgctgggattacaggcatgagccaccacacccagcctccataaatttttatatctataaatctagaattctgtatagaaatacagctgtcatgatgaccatcttgatgaatcttgagcagtgtaagatatcagagtacttttggaatcaccaagaaagattgtttcatttggtttactggcagtgttaaatctagttaattattttctgattatttaacttgatgaaagtttatggtatattgtgattgttaattaacataggacttacaatttagccaaaacaaaatggtagcttactttttcagtgtatctggagaagcaggagagtgtacaagttagtagttcatgttccagctttgccatttactagctgagcaacgaaatacttgagcaaattacggagccattttctgcctctatttcatcagtaaattggagaaaataatggtacctactaatggataaaatgagttaaaatgtataaaatgctctgaatagtacctattatatagtaatcattcaacaaatgttagtttattattgctattgttgttatcatagcattttctagtttgcttggcacttatgcctatcttttctcattttagcctcatgataaccctgtaagttaagtaaggcaaatgtcataaataaggaaattaaggattttttttaaagtgacttgttcatggtcccaaagctagaagtgttgctaagtggggctagatcccacatcttttgactgataatctatctctcaccatatcatgatgtctccttctcagcatgctgaataaataggtgccattatttctggcacattgtctctttaatagccacatattcttagggttccagttaaggttgagaagctgagatcatgttggcttctgagatcaaagataattttactgacctcaaattgtataccaatatgatgatagggtgttgagatgcccagggtaaaggagtcacatttgataaaaccttgtgtggattatcatcttttcataatggctaaatcttttatgataccgttcaagctcagtgacttcccaaatcatactaataagtacaagaagtgttagcaaaagagatgaaaaaattgaacttgtaaatgagacctttgtaccaaattcttggatgttttttcttcaaaggctcattcagggatcttgaattcttcagtgggttcttggtatcttatgacataaagcatcctcccattaggtctgggaaaatcaccacaagcatgccaatagttctgatatcttagcaacaaggatcttgcttagatccatgcttgcctttccccaaatctggattgaattactggaagttgaacgatctagctctaaagactgcacaaacattataaaagagagctctgttaacaccagatggccttatctgcagatttttaaaatgtagactataagagagccatataagcattgtccagagagacaaaaggaaagaaaaatacaagccacaatggtttgaaatatccagctctattttatagaaccttgactctactgatgttcttcaaccccaatcctgcagttattcatgtggattttaacgagagtagctagtgaaattcaagctcagatgtagtcattgaaccaaatagtataacgactaagttggagattttaactcacgacacttgccttttgttgtctagcttcaatactatttaagaaaataagtatttctaggttatttgagggattttgacatggatgcaaaatattaatctgttctttttcctttggccccaggagctgggatgaaatcacatgatttcatcattttgaatccatgcggctcctctgagatagggccagatgtaaccagaaggatttatagggtgtaaaattcagaatggattagaaaagcctttctatgttcagcccaacacatcctaaatcaacgtcccctgaatggaccagagcaatctctggctggcctagtggggaggttgtcatggcaactgactggcaagctcagccagtggaatgtgaatgcaaacaatagagtgataagactgtgtacagagcagcatactaaggctgcttctgcccaggtacagtggcacataggtgaaagtgtgaaactgttgctgcattttgtaacttcttaacaatctctggcagctcatttgaaatttaccaagtgccctttcccagatgttggtaaaaacattcctgctgatagataacagaagctatggaaaaatcagcacccagctgataggtgcagaggtatacaaagccctggagggctgttggaataacactactcaaaaattttctgaaggaggttgaagcaggtttaaggtaaatcttatgactcttcagtgccatcttgtgtccttttagatactgacaatttactagaagcccactctcagaccgatcattaggcagcagcagggcagacatggaaaagttagagctggattatattggagcttggtattcccttttacagcagaatatgcacaccaagccttctgagctttaaattgatttaaaaaattgaaattaaaaattttggtagaatctggaaataaaaacagaataagatgccaaataatgccatgaaaagattgcaagagtctacatggtgcgctaggggttgagggaagggatggaaaatctagatttagtgttgaagattcttacagatagatttggtattgaggattcttactgttgtcattactaactcttgcaatagaatatttttaatctattcagtcatgctgataatgcaaatgaatcaacagagaaaaataaaatgtgaacatcaccaattccactttataactcttttgttcatggttaatggagtaagagatggtagcatttgcttaaatggtacctcatgcccacctctaatctcttacctaccccaaacctaccacccactgatgtctcaccatcacctcatcactattgaaagccataatcaagtcccatttaatttcagaaatgcaaaataaccaagatgtgtttctgtgtgtttcttccagggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgc

SEQ ID NO: 4 - DNA, 11058 bp, Homo sapiens
gaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaaggtatgtctggattcatccagccaggtgccttcctccgagctcagaagggactcctttccttgagggggaggatagggacgtgttccgggatcccaccccgcccccaaccactgaagagtagccagctgctggtcccaaatgacctgattcgattttttaaatgtaaaccttaggattggttcttgggtgaagagtccgctgctcttcgctattaggttagcgttcggaagttttcagtccttgttttcccgttgacttcgctgcctatgtgcagctaggctggaagcagcaatcgctgatagaaagcctgtggttaaagctcaaacgacatagtgtagtctcgactaattgaatcaacacgtatggatagcaacattctttttaggtcctcctctggaaagggtccatttggccaagagcactgttcactgttactcaacctcctgaaaagtaaccatagtaactcacctctcttttgatgggatcctccttattggctgcctatcttcctttggaaagcgcatctctctaaatttagaagatgatgagatccgtaagcatacatccatgtagaaaaggtgcagttaaacatggccctttaaagaaatgctgtcttcaaagaaaaagtagcatttggcgatttcaaatcttgtgagaaagaatgtgcattccaaagaaagacggggttcgtgttttgagctaactgctggtttgttactttagagggaatacttcctgaaattatataaaatctggcattaaaacttaagaatgactctgatttttttaaaaaaatatcagcctactgataatcttccaaaaataatctcccaagtaaataactggtaagatgagttattcagttatttccaaatgtcttaggatagttaagattccttatgtttaaacttaaatctggacaacactgaagtgattgtgtgtgtttgaaggtttatctatctatctagtccagaccaaccccatctcaaatatcttagataatatcctcctgctgcaggctttctcctgacttgagaaccagttcatgtcagtgcagtcctgactcgcccgatgttatttgtgtctgtctccttgtttcaagatctcaggtaaccattcatgagcctgaggctgtgagaaatgctcgctgtgcaaaggggaactctcaccagattttctgaaactgttctagaaatacacttttcggattgattcagcattaccaggtaattgctagcttaaaagaaattactgtttaaatatgtatccagagaaatgaatgctaatgtaacattaccataacttataagatcaatataaggggttgtttatatagatggttgctgggtagaagtcaatagaggttttctgtaaaaaggacatttgtgggctggctgattttcctctctaagatccgtgtgaatagggtgggccaaattaggtagcctggctccggaaacatgccaagcggaagcctactgagcacacgagtgcatgtccgaatgaaggaagtgaggagaactctccaagttgcagaaagagattattgtgatgtttcaaatttaatttgcataaggtcatgaggatagaaacttatgaggcttcaacattttaaactcaattttcaagactgaatacgtcttaaatgagtgttcaaccctccagcatttgtaactttcacatgtactgtgcccttcctataggtaaccagcctagcaaattgcaatcaaatttataagaatataccatgctgcatttcatcccatttctttcctccctttataaaaataaataattgacaattcttattcagaaacctatttgaaaatttattctggtctagtggtacagatttatgaataccgtgagactttaagattattgatctctatagtcacttgtttaaatatctgtagtttaataattttaaggattaaagattagcatttgaactgtcaaaaatgttggttttgttggcccttagcaccatccatccttcttcatttatcatactgactgtattttatggtgagaaacaacccaaagagaccaataatatttaccgtcatctgccatgagatgtgtacagagttccattcatgctatcaatctgaggaaagtttgagcaaagcagccacaattattggttcatgtaggtgaattagttgtgtgattagtaatttataccacagcctgtctcttatgtcatgtgcataaaagttgaagatcattcagtgccctttaatttacgtgaatcagtctgccctttcgttgagactgctgccacaatccaaaagggcaatgaaagaggttcttaaattttaattttgattctatcataaatgtgtaatatgcagactatatcctgtgcaactttgataaacggatctgtttgaaaagtcattcatcagaaaattttatggtatttagcttcaaaaaataaaaataaatcaaatggtatcattataatatccacatttaatcctggagacattggtgggtccaaagttagagtgtggaagaaaattccaccaatttttatttaaggatctagtcaccctcatcaatttgaacaccagctgcacttgtatatgtaatgggttataaagaaggcatgcacttaggagtataagatttggctaaagctgagatcaagcaggttactaaaccaaattctaatttcagtcttttttactcatatactctatttggaagtttttaggcatgtgtgaaaattctatgttcaattttatgtcatgtaaacttcatggaatttagaagacgccttgatgcagacagagatgttgaaaacttttatcaagaggttgaggcccttacctccatacctgggctctctactgatgactcatgtcagctggcatcccaacaataactctaaagccaaggaataatcagttcagattgctctatttgtcaaagcaatatgcctcagaaacctagaaaaagctaaactgctaactctgaagcagaggtaggagtacattgaccaaaaccattcagcactaaaacgaaggaaggatacctttgagttttgggagaggccaatccttgtcgattcttttttcctttttctttttaagttgtttatctaaatagtgttaatacattaatgtttactctttgtaatctaacaccattttttatattttcttttttcctaattaaatttatacaaatgggctaattaacagagccatccaattcactgcaataattctcagctggggggaaggggtggcggaaggatattactgaaaagcactaagagctaaccaatgttgtcctcaatattgtaatatagccttatgtttagaaaacaaaagaacgacagaaagtgaagtgcagcaaaaaggcttcttggtagaaacacaagaaacacaagatctgaacatcagtggtgcttagaaggacaggaggtacacgtttgaggctgggaagtctactctgcgtgtgtatttcagagtacatattgttttcaaagtgcttaggaaaagggagcatgagtaaggaacatgaagaaaagttgggaatattgtaaagagagacaagactcaagagcctagaacctcaattctgcctccatgtgctgctcattttactgctttatggctcattttctctctatctaatgtgggatataagactacaagcttaagtagattgcttgagcatgaatgtaacacaatttaatgaagcaactgtagctctgtaagaaaaacttttatgttcacgggtacctgtgcaggactgttacacgggtgaattgtatgccactgggtttggtctacagattatttcaccacccccataataagtgtagtacctgagaggtagtttttgtatcctcaccctcctccctcaaataggcccctgtgtctgttctttgcgttcatgtgtactcagtgtagctcccacttatagatgagaagatgcagtatttggttttctgttcatgtgttagttctcttaggataatggcttccagctccgtctatgttgatgcaaaggacatgatttcattctttttttatggctgtgtagtatggctgtgtgctattccatggaagcacctatatagctctttagcgaaaaggtaccctgtgaatgaaaattatttcaccactagagcaactccaggtgaaacacaaatcagataccatatgagtgagggcagagagtcacccaactccacgcgaatcctcatgtgttttaaagtgagtaaaattaatgattaattcaatcttatgtttttttacaacccttttgggatagcagaagcaacgttggcgtggatagatgtttttgttaatatactcaagcatggagtggtggtggtagtgatatcaaagtggaagacaatgtgagtgatatagatcaggtacttttagaaaggctgctattatccataggttagggattaaaactcttttctttgagtaccagtcctgggtatcgagggaagttgtagtatctctctagcatatctctaggtatggatttcttggaacccatatactgcaatgtgcttccaaaaaagcaattttctttctaattcatttctactttccaaggtaaaagatggggtaaaaggaagcatcattcctcagaatcaggaatgcacttctagggggtggaaaatcaaaaagtttacccaagaagcctcctgcacttcgcctctaaatttctgtcattagcagggccagatcacggcagcaactggctttagtgcagcatctaaggaaacctaatggtgttctgtttggttcagagaccattaccattggagcaggataggcttgtggaactggtggggttttctttactattccatgcctgtgcttggggttatcccaagggacatggatgcaatctagtaccagacaatgctgctggtatcttgagaaactcttctaagtcattggctctcagtattcctggaagttcctaagaaagtctgctcgagctggaacttgttagtaattctaaattgccagtaaagtcaatattgtgcttggggtggataaatctgaagaaacagattgctccattgatttggagataaaacctgacactgagttctgctaccataaaggatattatccagaaaggtgataggcaagggggttatgagagagaagaaagatggctgatggaaaattgttaaacatcaacagagccaaaggtctccagaaggcacagcatcatagccttgaactttgcacccatctaccttcttgaatacactcatgaatgcttcatgcagcccatgcttagcactaaagagaggaccaatgtcctaggtataatataatgctgctgagcaggatatgtacttatgatttcaaaatgaagtcactgcaataataatacgtaacatttactgagcaggaaatatgagcacatgtgacaggcactgagtaactgctttttaaacatcatctcttctaattccagtaaaactcaatgagtttggtattgtccccccgtttaacagataaagaaaagttaggctctttgagtttaaatatcttggccaaagtcagtaagcaaataaactgtagagctggtatttgaactagtgccgttggacagaactagaaggttatgctgaagtatttcaagccatgcagtgagactgcagaatgtggttagcagggacagatggggtaactctttctaatcaactgtggtcatggcccttaaggaaatatctccagtagctttgtcaccagcaaatcattatttagctagatagggacaattgcacttttaaaggctcatgccaggctaacatgttacaaagaaaaatcagtaagacattgtgaagctgaggtgcctgatttatctataacacaagtcagttgttgatctgagatggaacccaccttctttcttgtcattgatcagcctccaccccttctgtctgtgggtaggatgcacacatctaataggatggtttcaactctgtttttggaatgttttgatttaaatgttgtggggggaaaaatgaaagccaaactaaaattaggatatattgaactgatcacttcttcaccatgtctccagctttgagtcttgacaaagaatggattgctttgacaggagttgttctttttactgtggtctgttatctcaaagtgtttgtaaattaatttgctgatgatgtttccttaatgtactgtctccagaccatgtaccaaatgaaatcacttacaccgtaataggatttcagttttctggaggcagaagcagagcaatgaggaagagcatttgagcaatcatttgtaattacattttaaacatttatttaaagaattatataaaaattatattgctagaactctaatgacagggatggtcactctgttctgtaacttttaatttgttggttatttatgttttatactaccaaatacactgagcttggcacagatattttatgggcccagaggatatagcattagaaacagcttgaatattcaagccatcattagccatttcactttcagagacaaatttaggctcagcctaattcagttttgtaatttacatactgttctcagagctcagaacactcagaatgtgaagacataaagtcatttcattttttttcttgtctatttcgtcatctttatttgaataataggctgggttaagtttggccttttagttgcaggagaactataaccgatttacacatgtttactgaatcataacaaccaaacttctttggatagtcagatcaactttaattaattatccagatgattacctgtatgtttcaaaaatagtttacacctccttcacccaaaatgcatgaccagtggcaatacaccagaaatatttggagttgttatagaatctgtactacgttttttcaacttgatcatttgcaatatcttcttgcagttttttttaactgtctaattacaatctagtatctttgggaggcagggtggtggagtctttgagtcagagctaggaggccaggctgggctctgcttctatgtggtagatttgtgactaatggcacaaataaggtctacaatttgattgagtgtttactatatgctaggcacagtgccagtcactttccatgaattatttcaatgatcttatgagccagtgttatttctatccttactttacaaatgagatttctagagagtttatgtaatttgctcaaagtcactcaaataagaagcagcagagctggaattcagaccacttccatctgacttcaaaacccaaactcatagccacgtgccagaatgtaaattattgaactcgtctgggctgtagttttctcatctggacactgaggaggctgaatcaggtgatggatacatagttatcagctccgaatgttttgagttctaatccagccaagcaaacagatgtaggaacttatgtttgctatatattttaacctaaaagtggctagaaccatcctccaaaattgatactgaaaacattttaaatagctaaacagctttcagggagataattgtcaaactgataccagctgtgaaggcttttcagcattttaacaacccatgtgggtattttttaagagcaataaactaaatggctaagtgtgttgcccacggaggagctgagactcaaatctagaactcctgggaattttctctgtattttcaggatctgatacattcagtatattaggctaattggttgatgatagccagacagtctttatgaaccttggaatcatttgatatgatttttttggtcttgatctgtcaaataaaaatatctttcctggaggtacacttgggatccagaactataagtttatttgtcatttggttctctaatctgccacctgccttcccttgtattactcattaaaagattcttaattggtcataaatgctgtagatattgcattacattggaagataaaatgagcagacattttaaaaagatacatataagaaagtcatgtttgctcatgatgaagttactcatctcattttctagccttttctcactgtcacctacactatagtaattcattagagcttgttaaaaaaattagagacctgcccagctatcatgctaataatagccattgatgcttctcaatgtgaacccaggaaaagtgacttcattcttcactatttagttaaaatgcagtctggctttgttcatgaggctaaagcatctaagccagtgtagggaagcaatagcaacaacaacaacaatcaatcaaaccaattgcctggcattctattgatatggcaatcagctgattgactgaatgttctgctcttaacttgttgccatagtgctactactacacctgctgaatgctgcaacctagaggctctcaaaatgcaatccccagactggcagcatcagcatcacctggaaatttgttagaaatgcaaattcactgctgctagcccagatctactggattagaaactctgggggtgggacccagcaatttgatttaacataccctccagataattctgatgctcactaacatttgaaaactaccattacatcaattagtgaaacagtttaaaaaaaaagtacaagtaattgtcacacgggataacccaaagcttcacctaattatttgattaaatccttaaaaaatataccaaagaaaatgcagtttactaaaaaacagcccctgagaaacctggtttcagtgatgctttctttgttctctctacaatcagctttgttcttctttcctaaacttttgaaatcattgaaaactctatataagctgagtttgcttactgaattcagggactgtgtaggtatagtagtagcaactattgtctttgcttcagttcacttgtgaattatcatgacatattcatttcttttaagatcagatacaccactgttttaaaattcttcattcccttaacaaaacataacaactataacttaaggctttcttgggttaataatccacagtgatgtcagtggaaaactggaatgcttgggaatgattttgtagcttttcttactgactgaggaaaatcatttagctacaaaaagttgcgggaagcttttgtagcttagatgcactgagttggaggacaaactagaaaaagcaaattcttgaacacatttaaaatatttaagcttagaaaaatttaagattttagaggaaaaccatcaaatgtcttgctgtagatttatttaactaacacatacattattcattcttttgtgaactaaatggtttcaacacatagaaatatttgaggatgtgtattaagggtaaaataaattatgtttaaatatgaagtttctttctggcctggtcccccgaggttgaatgagaattgaactggactcaatttgttttctaaattcattcagtgctttctctagaagctgcttgtctttagctttcaaagtagatcttgcctcctttttgtgatatgagtgccacctagagtacactctgagaactcccttaagcactatcgttaaactaaacgataactgaaaattggcttttggaactccgtccttccttaagcaagtaagaacctcagtagcaatcgtattttaaaggagaaaacaaaggtcttcactttcagtattatgacaaggtcaagtttgcaagtcagaacgttacctaaatctttcatttacttagaacaccattaaaccatgtgttaggacgatggctacaccataatcatatcatagagtgttttgtctacagatacaccattatttctttaaagtgtaattgggctgccaactattttatgccagtttgattaacctagtgacactaaatgatctctctgtattaggcagtttaactaaaagaatgatgaaaaatttcttttctcctcccattacattccatttcaaatttgggtgtgttttgacattaaatggcatgaaataaaatagtatattggtatttgacttctgaggggctgcataaggaaataaacatgagtatcctatctagaacatctgttttgggtctgaatggtggtattttcctgcctgcaggcttttcaatccagggcagttgtcactgcttcaccacgttgaagggagaataccaatttccaggatcaccagtttatttttatagataaaagttatattataagatactatttgccacaataaaatctaacctttccccaattattttatttgtttagcttatccaacaaaagtattaacatatacattaacaacgtcgaaagtagcctactttaagagaaaatatgcagaagaagaagatttacatcaagattaccatgggtattttccaaaagtaagggtttacttattattatttgttcattttcatgaatgttgtcaacataaaaagctgtagtttttgtttttctaaatatagatttaatgatcatgtttgctttccagcacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtcca

SEQ ID NO: 5 - DNA, 11189 bp, Homo sapiens
cttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggaaaaaaaaatattccacagggatctttgcatgatggtgtgtaaaaacttggttgaggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcaggtgagcctcatgcagcatacactgtagcagttctctattgtcaagtacaaacaactccaaaactgagtggttttctaaaaaacaaccattttattgctcattaatctacatacctgctaagtgttcttttctaagcctttcctggaccttgcctgggtggggtgatccaagatggccccattcacttgtctggtggttggctggggctgttggtggggcatgtctgttcttctccatgtggcctcttcagcaagagagcccaggttccttacatggtggtagcagtattccaagggggcaagcctcagtgcacttaccaaacctttgcttgcttaccttgtatttgccggtttcattagacaaagcaagtcacatgaccacatccagactcaatgtggcagtagacaggcatcacattccatgagtttaattgaatagagcttataaaagagactacttacagaggggtgggcaggactaataacaaggaatggtgaagcacttctgagctagcaatagcaggaagttgttaccaccatagtcctgggggacaggagaaggaatgattatcagaacccagcaatagttacgactgtgggcaaggaactatcagtagagaaatacagccactaccaaagctaacagggagtgaaagagggaaataaatgctgtagcccctcactcctcttgccctgcagtttcattggccattagccaaagcctactgaaagccagagggtaagaggagctgggtgatatagtcatgaggtcagctcctgagagcacagagcaaagaaggtccaagaacggatttggagtgaaaatagagaataatgagcttcttattaatgatttattttgaaacctagaatcaaaagccaatttaaatatctatttttaaaagttcaaattatgactcaggggcatttcctttaaaaaaaaaaaaaactcaagttacacacatcagccaattcagaactcagctctccctttgctcccagggaaagtagcccaagggttctcaagcctggctgtacattagaatcaccaggggagacttttttttcttttactaccagtgtttgggcccaatccacaccaattgaaccagaatctcttgaagtgagacacaagcacctgtggcccattaaagctcctcaggtgattctgatatgcactcagggccaagcaccattgaactagaagtatctcttagctattgatgatcatttaaataaacttcttccctacaggaaaaagccagaaagttctcctttagttttttaattttctctgccctgggctgcttttgaaaccataatgagccagtctgcattgggagttaccatgggggaaggattttaacccttctgaatattttttagctcaataccatatatactagggaaattctgaaataagtacctccttaactttcaagttggactgtgaaaaaatgtaatgtgttttgtgagccagctccttcctcccattcccattccactcaacctgaaacaatactcttttgtcacagtttcacagtttttgactctgaaatcacctatgcaccatgccactaaaaaacccatgttattaacatatgagtaaataaaaatcatcttgaacaagtagctctccttggagttcctgggagcaagcagggttaaggggcaaactgtaattatcattactcttcccattggtgtcaatcccaagtgtgaaaagagatgagcacagagactctgacttagcacaataagctttttattgtattcttaatttgagtcttagaaattttgagacttaatttgagtcttagaaatattaagaatattcttagaaagaagaatatcgtttctaattccatcttcgtgctctgacctaaagtcctttcaaagaaaatgttttcatccttaaacaataaaaattgaaataaacatatgaaggggaaacaacataatggaaggagtgagaaagtagataaattaatctatttaatataccttctttaagaatagaaattcaagggttcaaaaagcaattttaaacattttttttaaatgtatgaaagctaaaatgtgtttttgtactggatggagattaaagatagataaagttgatgcccagaggacgacagatttccactatgctttgggtccttggtattcaatatgttttccaccctctgtcttctaaaacttgctctttggatcccagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggtgagcacgtggcagtcagcaagtccctactgcgagtcacttctgaaatgaccaacaggaagtgtgaagggcataacaagatcctcaaaacacgaccttggattcaggcgcactgatagctggaaatgttcttcattttccaagagaaaaatataggactcagcaacagaattggagtgaaaataagagggtcaaatttaatccagcaaatattctcaaaggctcctgtcagccaggcattgtgctaggcactgtgggccatgtacacatgagaaagacaccacccctactgccaagaaattcacggcctatgggaggctacgagcctccagatgaattttctatcactcaaaatataattcactaagagatccacagataaaatgctaaacaaggttagataaggaaagatctcaagaggcaaagttcgggaaaatctcagaataagttgactttgaattgaatcttgaaggatggttagtattaatagtttgtcaagtggaggtggtgaagggatagaatcagaaaatgggagaaagaatagtcagtatagccaggacatgattatgagctttgcttttataaatgccaaagctttaatgagaattcaaaaatatccaggttccatttccagtttaacagttcacatccccagttctaaaaacagggaattttatatgatgaaattgagtttacacaaggacaccagacttggctctaagatccaccatgtcaacgtgggccataagaaagactggagggagtagactgggaaggggtgggtttgggggcttaaaattagaagagattggaaagaaacactggaacgttcctataaagagacctagggcaccaaaacctgatattctacaacacagaactccgacataatttatatttccatgtttcatgccctttcctcaatcagtagggtcttgaatattgattacaaactcttatgtccaaatgctaaaaaggagaaaaagagacattatagatttaacgataattgtacatctataatctactcaatgtgggtaacttatgttgtgtgtttattccctgggagacgttgaagttctttgtctgatatcctaaattttcttataataattcattccattttggtgagcagagaaggatacttttaagatttttagaatcataaatctaaatagtagtttcttggtatgcaagcaacctccaatgacttgaaaaaggagtaagtaggcataaagggaacactttgtcctgttgtgttgtacatactccatgttaaaaatatctgattgcatattttgcctgatcagtatgaaaactacgcaaactttagtgttggttggcaaaatacttgtgctttgcttacttttgcaagtaatggcatgcttatcgttgttaagaaggctttcatatgataaagcttttaaagctgtgtaaatcaatagatattagaataataatgagagtttcaaaactcactagagccaacacaagctgacctaacccattacggcccagaataatgaactaaaaaatcattgctgagctgccctccaacagaaaaaacaatttgaaaaaaacaggaagtattcattttctattaatggacccactttacttgcagatgcagctagataatgcatcaaagccaattagggttccagaaggagcgtctttactaatagaagggtcaaactcttattgacagagttgaactttaagcaagaaaatgtgttcctggaaaggcaagtggcatcttgattctgccactttgaatttctagttctcatctttagggagaaggtttttcttctacgcccagtgtactataaagacagagacatatgcagctacaaggtttaatcagaagccaggcaggtggatggataatgactatttcaatttgtatcattccttgagtgcagaatcatttaagtgggagaagggtctaattgcctttgaataactagtttccagtcagcactttaaatagccccttttttttccagaatcaaaatccacacatgatttaaatagagcccacttcaacccagcattgccccaaatgatcatgtcgcatgaactgcacaattattaatagatttccaccttctcattgaagttctcatttctgataacgggacagtatgtggaagtttcctgcatatctaagatgtaattgcaatcacactgtaggggtaaggagagtcttatgatgtttctctcataatctctcatgaccccaacagcaacctttacccagctctatcaatcatgatcttttctcatcacttggatcaatagtgaagttttgggagtccttaacaatgagattttcaatacatcctcatggattgtcaagaaattactttatttaaaaatctcgttttctgcttaagggtatttatgtatataaataataaccttatatatataaataaataactatatatattatataatatataatatatatattatatgtatatggttattatatatatataaaaaccatatataaaaataaccatatatagatataccttctaaggttaaaaacataattttttcagaaaacttactgaattggaagcaagcctatatcagagggtttatgggaactgttgctaaggaaataccttagcaatgttcaaactttgatttaaagttatcagtggtaagttaggcatgcagtcccagctactccagaggctgaggcaggagaattccttgagcccaggagttccaggctgcagtgagctatgatcgtgccactgcactcgcactccagcctgggcaacagagcaagatcccatctctaataagtaaatatataaataaaaataaagttgtcagtggtagatgacaggcacacgttggaatacagtgaggctgattctttagcagtcctcacattcttctatcagtgagaaaacacagcatttgagagctaagactttgagttctaacagggttttgccattcaccagctctgtgacctgattgcctcacctgaaggatagtaagagaactgttcaaacctaggatcagaacaggctggaagtatgaactgggttctaaaagtcacctggcatggtctgaagttgaagagattcccggagcgttcagaagatgggctgaacagctccttctaaacttttactggctctttggtggtcatcctggccttctcacaaggacaaacatgtaacatatgttgggcactccagcaaatttagaattttctaaatagaaatataaaaattggaatgggacagccatcataaataaagtcctacagcatataagtagggtgatcataggggcattctccaaataccaggaagacatctacaaggagattccagacttttttttttttttaaaagaagctaattcttttatataataaaggggcagtactttctgtgtcaaatattgcatggggtggaattttcatatgcttcagaagtaagttaggtggaaatcacagatgctcattgaacataagtctgtttcagctcctcccagatcctttaaggatatacagagtaacctcatgctctacttcaaatatccccaggtgaaggcccctcagtgcattcttgtacaggagatcctagaatgtttgcgctcaggaatgccatcattttaaaatgaattatttttctcatttgagcttttcagagcatttagtctggcaacataataattcaatctacaggaacatttcacattgctctgatcctgtaactttcctttgcactgaagtgtcattatttctgataccatttgtagctggaaagggagggcttaagaaccaagtaaaattggtgagattatccattttccaattgagaaacctgaggtcaaaaatgtgagtctgtagttcaaaacaatcaaaatcaatgccctatcttactatgtaaatactgattttaaaagacaagtgtcaattatccaaacagatgacagagaaccattgccaggtattcaaagttatgattaatctggaaatatgtttgttttaactttgcaaatttctatttgaacatggataattctaatgtcctgagaattcacgatatgaactgaatacagaagactcagctcaataaaaattgggaagtacagcaccacaataggtacaaagctggtaatcattgagtgatactggttgagagaaaaacagtttggtttccccacactgcctggcagcctcctcctcttcttcccaggctgtagaaggatagacagcattaccagtcagggaaggacaaaagaaaagcctccatagaatcgttgtcttcacctctggttgctgatgcatttttctcagtggtgatgggaatcattcattttctggaatttaaagatttatgctggtagcagccctaggtttcatgctgcatatacagcaaacataacccaagcagtaaagagatcaaccaagagattaaagccagccagttacaaaatcatagtaaatgtgcatctgttaaagaaaagacagttattaaactcatagaaatgaatcttcagaaatgcaacttaaaaactattaagcatcccagaagcaagccaagttctcatacggtaacaataattgcaagataaactaatgagcccttcgttttgcaaaacattattccaagcacattatgtgtataaactcatttgatctcagcaaattgaatagtaagtgatgaatagtgtggactctgactccaggttgctagcattcagactctggtttctccatttattagtactaagacttcagacaaattccccagatcgtttctgactgcttttctcatttggaaaagtgagctaataatagtacacactttatagttgatattgttaatcttgatgttgtcaaagtttaatgagtggaacaaagtacagttgacccttgaacaacatggagatttagggtgtcaacccccatgcagctgaaaattttttgactcccccaaaatttaactactagtagcctactgttgactggaagccttaatgacataaaaagtccattaacatctatgttttatgtattatttactgtattcgtatgataaagtaagctggagaaaagaaaatgttattaagaaaatcataaggaagataaaatacatttataatactatgctgtatttattgataccatcagtttatatcatttgtttacaagatgaatcatcagtctgaaatcttcagtacacattaagcaattcaactttttcttgaaatgtcgtgacttttttttgctttttgggagcactgctagcatcactggtggcactttgtatgggtgcatgatgttattcaaggtttacagtattgcactaaacatgattttttttaaatgtgaaactgcaagagatcactttttactgcactatgcaatttactggagagatggtgaggatgattagtatcacagagcattttaaacggatgctcacaacacttgagttcaccacaataataggaggtggctatgaaattattagagtagtacagtatggactacagttaattttatacaattatgatttaatacttcacctttacatttctctcaactgcaaataggcccatgtatggtctatatttgtttaagtctcatcaattttaacttttcatagtagatttatatgtattttatgatagtaaataatagactagactagtatctacatatattttatccattcatgacatgcctaattttttctaaattttctcaatatttctaagtaacacattcatctgcaagtttgtcttaattgttgcaaatctccaaagcattttccagtgtatttattgaaaaaaaatcctggccaggtacaatggcacatgcctgtaatctcagcattttgggaggctgaggagggaggactgcttgagcccaggagtttgagaccagcctgggcaacatagtgagatctcatctatacaaaaaatagaaaaattagccaggcatggtggcatgcacctgtggtcttagctatttaggaggctgagatgggaggctcagttgagcccaggcagtcaagggtgcaatgagctatgatcacaccgctgttccccagcctgggcatcagagcaagaccctgtctcaaaaaaaaggaagaaagaaattcacacaaaagtggatccacaccattcaaacccatgatgtccaagggtccactgtacatgctcatgctcattagcaatattttttatcatccaggttggagaagagaaagctgagcccccaagatgtaatttgttcaaagggacactgctaataaattagccatggtttcaatcctacagtataagaagtgtaattcaacttggtccaacagatgtgaatgcctaccacagaagtcattgagtgtctttctaggatagaaagataaatcatatataagcctacgctctctggtagggaaaattattaaaaatgaaaattaaaaaagcaatgattctgaaaaaatatattcgttcattaaaaaaaaaaaatgaaaattaagcttctacggtcacattcaaatagagccatagccgtcattctgggaagacaaaagaaaggatggcccatgctgaccaaggaggttttaagtggtttcacccaagaggaagcattggacccggacccagaagggtgaatggatttttaaggggtaacctgagttctgtttcttttcccccttttctaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgaggtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctatgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 6 - DNA, 158476 bp, Homo sapiens
cggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggtgagcaagggcctgggagcagccccagacagacgtgggcctggagcagtttcctaggtccccgtcccagcctcgcacccccgaggcagtgcgcccaggcgcgtggtggaggtaaggggaccgctgtcctggcacagagctgtccccgggctcggtcacctgtgccgcacgtttgggcttggctggttagctcaagtttgggcatcaagctggggaaactgggtgaatctccaggaacttggtgctccggggtgggcaggattcgcctgacgctctccccttgtccctgcggctcccagctaggcggcggactcttgccctctgacagttcctcctgtctctgggtatccaagtccacgtcactgcgccccgagcagtttttctttcgcttagttctcggatgaaataactgccggcactttttcgtgataaatcccctagtaacttccccttggtgagccgaggaagggatgggaggggtagagaaggagaggactttaatcacctccccccgccccccttgcgaaacctgctaaagcttaaaatcgtggtttcaacgttaccccctgcggtccccgtccattgtctgggcgggtggtgagtgaaagggtgaccgcaggcagataacacagccagaacaggaattagtaggtaggcctgggagacacctcagtgagaggtttgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcggctgacacaagttgttctaacagggtattccgtgcgctcacagttgcctgacagagcagcaggttcctttgctcccctaaactgaaaatttaggggatttttttttctttgaagttttttttttctatccctgcgtagacagttgccagttaaactcctacttcctggtattttggcctgtttgttcttagctttttctttagcttttatcaaagaaaaatctcacttccttttatccgtgcacatcccttcagctgtcggcaagctcaggtcacagaagaggtttgaaagcctctgaatctctcccaggaactggcggggagaggggtttgggggccagagcctgaggaagagattacaagtgtttgcgagctgctgctgctgctgccgttgctgtgtgtgtgggcgggaggagtgccctctccagatctctttattaaagttacatttctgggtgaggtaatgagctcacctgatgtttctgaggctgagggaaaaaaaaggcgtctgcgttctctgacaaatctcgggctctggggcggggactgtgaaaccatagttcaaccggatttaaagcaggtgtcctagtgtaacaacgctggggaggtaggtggaaaggcgagacccccttgggcctggcacagtgtggatttcactttttcgagattccactgtccgatggaggaaaggacactttggagccagggaatgagccaagaagggaggacaagggtgatgtcggtttgtaacatgcaaacgtccacacgcccacagttggttttccgattaaccccctcgagacttggagaatgtaatctcaccctcgtccacacccctgacacaggcacataaccagtttccttttcggtgccgtcacaggcgggccacgtcgcaggataggtttttctacacatttaactgctaaaagggggaaagttccgctttcagacctccttcacggtggttcttttggcgccacaggctcgtgtgtccagggggcaccgagctgcgcgctttcggcgagcggctagccccggctcaccgcaaccagccaccgtgaatctgaggatccgatatcggccctggaccctcagatccgtggtttcggtgaattaccgagctggcattgccgaaattctcattgcagtatcagtgtgttttgaaaggaaaggttacagcactaaaggcgccgtgtctacactgaggaagcaagtcttggacagtaagtgcgccttcttcggagccctctgcatagcagagcccggtgggggcgcggtgccaaaggccggcttcatttgagcggggtaactgccttccctgccggccactcttcatttccggagcagttttaatagtgtatgtccagttgtagaggtcaaaaactcgagtttgtgaaactgcttccccgggtctttcggcttgtagtcgctacaaagtcattgatatattttaggcgtgccacgttacctgttttgaaaggaggagaaaaatatatgaaccacgaaaactgaattcagagatgaaggcaatgaagtgtgtgttcaacatccgagatagcaatattctcgttattcttgtagaaagagcgtcagcctgtggtgacattttgtattgcttaaaaaaagaatgcttttctggattatttacaaggagatggggcgctgcagttaactctttcttcacttgggtcatctgtatgaacccctctatgggatttttcataactactcactgatctcactgatataagattcattctaagacataagcacacataaagctttcttcagtgggatattatgtttgaaacatatcaattgatctcaacaggacttgggaaagcatcaactcaaataatgtcctttcaaagactattgatgtaggactattgaaattgattaatttaaaaactaaaaactgtttaacagccaatatatatatattttttccttaaggatttatttaatccaatagcaatttacaatttaatggagcattatttgcagtaaattgcttttctaggctttcttcaggacatctaccttcaggcacttgagcaagtcatttaacctttttgagcttcagttttctcatacaaaataaaaagacagactagaggcctactctctgaaatgtctcccagctcaaaaactctttgtttctgaagtcttaaggtaaaaaaccaatttaggcaggcagagtcatttttcaacactatttttctaaggatctcagtctagacaaaattcatataaattgtattattagaaaagtatcagtagaccccaatttctaatttcctttttttttctacctttaaaaattcatgataacatctatgcttactctttccagccttagtagggaaaaaaaaaagcgtgaaggagagaaattagccttccactctcctgggaaaagaggacccaaaagtaagaaaggatagtaggcctcagaaagccctgctagtgtaactcatctctcctgcaaacctgttcctatataaactgcatacatagtacctagaatgagatgtaaattatggtttatgcttaaatattcatatgacaaagcctcatattgtacatcctaaagttgctcaaaaagttgatttgcaacatggttgtaaatgcaagacagaaggaaatagaaaatactaatatttttctattgttttaaaacttgtagaaatccaaaatatcttgtcttaccagattccaaaccttttctgactttgtaaaaaattcaaactagcttatcttttttaatagacattcagatgaaaatgcatgtctaccattgacttatcaaaaagaagaaaattaattaaatagtcttgtgttattagaaaaattgtatattgtagtcagtattcatgtgttcagtttctaactatgtcatgtaagaatgttgtgaccttgggaaaattatttttctgctcttttttatttcccatctgtgaatttctttctgtgcaatgtgtggttctgattgtgttgagattagtaattcccttgctcagcatttcaaattttttaagtaaaacgtgctatattaattaaggcttttattatattgttaatagaataacattctttaatttattccacttaattatcacttttatcattttattaaaataatggaaagatgtttctttttttttttctcttttttctttttctccgtcaaattttcatgccactaaccgtgggcctttgtaaaacttagtaccacctaagttgtcaatattacttggtgtaagatggcagcagtttgtcagatagtattttaaatgctttataatcaccatgttttacaattccaaacacacttctttctgttctggccatttatttagcataaaacaccatcaaagagttctagctccctgaaggtattcactcaagtagacacatgcaatttatagcccagatatgcagaagatccacttaggtatagctatgatagaagaatatgtctctgtctcaatgtatacatagaaacttaaatgcaatttctcacaatgtgttaattttattcttcattgttaagtattcacagaggctaatctcatttcttacacattatgtgtgtgacacatgtatgtgacatatgaagaatgaactaacttactggaatactaaagaatggtttcttgggtgtggtgggtgataacatttatttggttattacttttggatttcaactcagtttattttcaataagaaatggaaaaaaatccatttatacttttgattactttttttattagggtagaattttcctttccttgtggagagtaaattcaagactaaaatagatattctatattcaggaagagaatattgcaggctgtttggtaaggttaaatctaaatcctacaattattatagtgtccctatagtacgtaagtcattaccatatttttggagttactgatattttcatgcagctaatttctctgcttaaataataaattttacattctcttttctcccttattattgaatagaataccttatatatttcagataggcctagttccaaatgtggtatggtattcagtaattgttttatgctaacctattatcatagcccattactgtagtctatgttccaagaatgaaattagcttttaatgcttcctctcttatttatccagtcagttctcaattatccattccattgaaggggaaatcagagttgcgcacaatccaaaacatcttctaaccaaaggattacttaatttgactttgagttgaggtacttcaatgaacatgtctatacttgtctggtctaagaattcatagtacttcaacacaatgaaactaaactgctggggaataggttaatcagaaattagacagctgtccagcttctctgatttgcttctctattactgttattattgttttagctcttttctgtatcacttaaggaactgatgcaaaatcttggcccaagtaagactaaaaacatctatgagatgaaactaaacctttgcaatcttctcaaatcctataaatattatagacccttgatgttcattcacaggaaaacatactatgaccatggcaattgctgtagtcttctggcctttgctcaatgacacttccactatgaataatttgtttagctctgcaaaatcacatttcaagttttagaaaaattttaccctcacctggccctttttcttaagcaagttttttattacatcatatgagtttccatgaataaatgaataataaagcaatacccttttcatgttatgagttgggttagcagccaggtaggttgactctccagtaggattttcacacacctgcttttagaaaaaaaaattactacttataatggattatggggttacagtaaacagtgaaaaccagtaatatcaaatccataaatgttaggaagattggaacttgtaattaaaaaagactttatttttgattattttaacttattatgatgatttcactagagaagttaactgaatttgtagattaagatatcaaccagcactccaacacaatgttttcttgagggagataaatctcaaagatactttcaccttagaaattgatataagtagatttttatcctctccatctgtatagttttagagagagtctagattaccttatttgaactgtgaatgaagaaaaaaaaactttcctgtacttacttgcctttggtgcaaaatcaacattggaatgttgataatgactaaagtgagtcttaacttttcccttttccttttccctgtacttgtctttgctgtagtttttaccacattgtattatgatattggtgacttttttcagttgaacataaattttttgaataccaaatatcatctttgtctatgtatcctcaagtctagttaagagcttgacacctagaagctgcttcacattttttctttgcattaaatacagtagaagcaatgcatatgtggagaattaaactccatatggcagcacctgacattcatgcattactaagaaattttctcaaggagtttgggagttgaggatataatattcctcactgagaattgaactggaaaataaaaccatcatgaaagaacagagtgggacaggctatcaagacctgatggcactttagtagtattaatgaaaaacaaaaagaaaagaacatgtatattcgtaaaggacctgtgattaaggatgaaaaagactttggtcattggagaaacacagaaaaagtagaggagttgggccaaatgtggttattgaagctattatacttaatgaatccaaacactttcttttatggtgaaagtaagtggcccctctaactggcagacatgacttgcccagtctccttagcaggtatagctttttgttgagatagataaaactcattataagaacctaattctggggccaggctcagtggctcatacctataatcctagcactttgggaggccgaggcgggcggatcacctgaggccaagagttcgagaccagcctggccaatattgtgtaactctgtctctattttctttttttcttaaaaaagaacgtaatgctctgaatattcaagtcatatagtaaactttcccatggtggaatttcatggtcactaagaaatcttctaattataatgtgatgcttgttttttgtttttgtttttgtttttgagacggtgtctcgctcttgttacccaggctggagtgcaatggtgcgatctctgctcactgcaacctctgcctcccgagttcaagcgattctcctgcctcagccttccaagtagctggaattacaggtgcccaccagctcgcccagctaattttgtgtatttttagtagagactgggtttcaccatgttggccaggctggtctggaactcctggcctcaggtgatctacatgccgcggcctcccaaagtgctgggattacaggcatgagccactgcaccgagcccaatgtgacttcttatatagccagtttacagtcagaggatgcactagctggaagagaagcattgtattcccttggcaataattgctcttatgtataccaataagctggtttatgagtttggttagtgagaattcatctttaaaagatgggaaaatgtttggtaagcagccaaaagaagcttctaagttttcagggttgaaacctacacattgaacccttccaaattcagcttgtttgtggtacaatcagctaaccattccccaggtgacacctatggtgtcatttgttgtcaacttgtgtgttacctattatagacatttattttctttcttgtatatcttttggtgctatcttgcttaatatgcatattattagtaggttgaccattcattcatcttggtatacctaagactgtcctggtttatgcctcatgagctggtacaattattaatggcatcctttttcattttcagaagtgcattttgcataacatatcatacaggctccacaataatttgtaacttgtctttatgtcttggagtacttcactgtgataaatgcactcttcatcctaaccaagtgcatatttttaacccatttaaatttaattatcagctacagtgaaatatcattaatgggttatatgcccctttcatgtcaggtataagaaagaaagatgtgaggttgtagcctctagaattccagaatgttgtggatatgaaacattgaggatcctatggtttggaatggaaactaaattgacctcagatgccaagggaataattttgtttgaaattcacctgggagctacacttagctacggggttatttagggaagaactatttcagtatgagcatgaattccttttgcagcaaattgtacaactcccattctgttcttctatgagatttctcagtaatcacactaccaatttttttcttaaaaaaaccagggatgttgaaggaagccccagcattcttctgtacatgcaaactaagttgtatcagtcagaaaaggcgacctgatgtggccaccaacagtatggctaggatacggttgtagtcaagggtgtgacaacagcaaagacgcttatcgcggaaactttgaccctgtattaacaattttcaccttctagatccttgggcaaaacatacggccttttgagaggctcaagcagtgttgaataagaatactttcacttagagcgaaaaccttaactctctccagagttaaattatggaaagttcagtgtgtgtgagtttgtgtgtgttgggggctggagaggagagagaaagacagagacagagagagagagagaatgaattctgaaggattagaggcatggaatttattgtcacaagttaaaatatggtaaaagaagggttgttggaaaaatgagaatgttcttttgatgttctttttgtttagccccccatttgagagctgaaataaatgaaaccacaggtttaagagattacctaaaatccagtagcaaattaaccacaattcctagtgacatgttttcagtttcatttgcgcctaaactcatagattaaaggttttgacctgtaaagaacctaaaaattaattaactacttgactaaggtcacattgttggccaatccagaactaaaactcatgtcaattgatcattcagcatatataacagctttcaacaaatattaatggagtgctcagtatgtactacacattgtgcttgaggatatggaaataaactaattactatacattcaagatcctatcactcaaagatgttatgttctctcagggaaacagatatcaattaattaactatataactatttgctagaaattttggtaaatgtcacaagaacaatgaacagcattttacaacaaaggggccagatctagtctgggatttaagagaaactcagaaaacgtctagcaggaagtgatatctgagctacgtgctgaggaataatctagcaaaggatgtaggctgaggaaataacatgactgaggatgctaaggtggtaagaaacatggtttctaactcctggaggtgaaaatgtgcctatcccttttcatgaaaactaaagaagttttgaaggttgaggcaaaaaccaaggattccttgaagttgttcaaatactttcctgcaatctccctaattgacttgccagttgtgggatctacaaaaggatgtctttgtcttattgaaatattcacatattagtaaatatttgtatgtatacctccctacttaaaaaataaagtggaaacataccatatacatcattttgtacctttcctttttcatttaacagtacattttggagattaaaaaattgtctcatagcagcacctatagctctacctcatttttaaaaagtgtgcattggattttactgtactatcatcattaatgtaaccatttcacaagttcctggaagtttaggttgtttccaatctttcgttattacaaactagagcagtgaacatcctaatcatgttattgtccatataagcaattggtggcagttgttggtaaaatgtcttggaagtgaagttactgagtcaacgatgtgtttttcatttagaaagaaattgtaaaattactgctcaaagagtacacatctttaaaaaaatcccaacaaaagtaagataatgcctttcttaaactctcttcataaatctgtactattacattcctctttttaaccagtatcataagttggttttcatttatttaaagcttattggaaaagttagaattataggagtagtaggcatatacactcacatacaaggcaaaacctatattggtgcctaactttattatacatgagattgggccagaaatgggaaaagacaggtatttaccatgaatttttattattgttctttctacataagattgctaacttttagaacataaactgtataattataagccataacctcttccattttgtaaaattaatactctgtacaatcaggattaagagacagccacatttgagccataagtgaatttaatactgcttttcaacacaaagaaatggtttccaaatatttgtattagttcgttgtaggtacagtatacattttatgggtggtctgactaatgccactttgtaaaccctgtataatagtcattactaaacaaacttcagttatttttaagtaaatcatatttcgaacaattattccaacaagtttaagccttaagtaaatcatcttttgaacaattcttccaacaaagcttgtcagaattttgtataaactgataaaaagtacaatattttacaaatttttttaaaaatcagtgccactaaatatttttcacctgtaattttttaacccattaaggaaagtaggaataaaatctattttagtcacttttacatagaaaatagcaggatatatatatatagttttgaaaaattatatgccgaaagtaatatttttaaacaaatgataaatattcataatggaggtaatgtttgtatgcacatactgtaatttaatgagtaaagcagtttctgcctggtatttagtttagatgttcaaatctggggcacttatactttattctgcaagcattttccctacctggtgataggtacaacactttctaagaagaatgtttatggtgattttaaggtataggttttatatttttgcagagatggtcatggatctaagtatgaataacagttttgatatcagatctaagagtaaaatgtaatttatatttggatttactccattacataaatcccctgttccacccagcctcaatggatactggctagttctcaaatagttttttttttttttttgagaaatgcttgtttagtataagattaaatagcttctctgatcatactagaatggcaaatacgtatctgtttattaaaacaaaacctttatccactcagctgttttcctctttgctgttagaaaatgccacctttctaaaagagattataaaatagtaaaaaaggagtagggtttcagggtatggtttggaggttatcattttctagaatccatccaaagtgtttggttagaaatgatttgaactgcttgagtagtgatttgatggtaggcagtatggccgtatctccacggtataagaagactattctccaggcttgatcttcatgaactgtctatgctcagagactccagactgaaatctgcatagcatagatttctttatataacagctcaagagcttgggctatggatcagagcatgagtttgctttctagcttttgtctgttttttcatttgttaattgaggatagcagccaagttcatttggtaggaatattcaagaaggtaatgaatttatattatgtttgtcagtgcctagcacattgtagacactcaaccaaataataatcattatgaatcacatttttcagtaacctaataatatcagttattcacatcagaaaaacttgtgaaatacttcattttactgattgagaaatatttcagttccatctgaatacattttgggcttccataactaaactgaaaagtatattttattagaatgtttcataatctcaatgaatgtcaagtaacctttcagttttatcatctcaggaaaaacaaaagaacataattgaaaattatagctttaaaatgtaattttccacaaaaaaaagagaaaaaaacacgtgttaaaattataaagacatatgtaatgcactatattattctcagaaattgacattattatatgtgtttctgtaatttgaaaatattagaacttagaaagaaaaatttccgattgttacaatgctgtcattttgataataaaattatgattttaaatacattatttctcaagtgtaattcaatagagggagctccactgcttcccttttatgagcactgtaggatgcttccatttattatgattttccaatgacctctaatttaatagtgaacattattaaaaacctataattttaatattaaggatattttggaaagtgaatagtatcctctttctattcatataattcaaaaaatgcttccacaaataatatgtgttttaaagccccagttcttagttctttgtaccttttgcataataactcactagacatgattaaagtaggtatactcttgagaaacatactttaatacaccaaggcatcaaaagagaaaaaagttcatttctagtgataaaataatgcatgttttcatattaattttgtggtagctattaagttaaaactgttatatatttgaatagtagacaaaatcttttaaaattactctgcctagatttttaaccaaatggttacagatttccacatggaaatggtcttcttccttttttattttctcatatattcccttgatttaggtaatcccaaattgtattttcaagctaaattgatattcatcatcttatctattattactttaccttttaattttgttatgatgaaagaagttgttgggttgattttgttcaaaaatttataattttgtcaaaaatccactaacatggttaaaaaatttaaatggtttcaattttataagacatctcctaagatgtttctacataagggagttatccactctgtgtgtgaccctgacaattcatttaccttttatgaggttcatttttctcatggaagtattgtaccatgtgatttcttcacagctcaaaaattctaagattcaaaactatattttgatttagaagaagaatatgcacgcgcacttgtatgtttgagtcagtgttgagcaataattttacctgaagtctaattaaggaaaaaaaattcaatgatgggcctcatttttaaatttgaaatggaaatgattttattacattctatagaaaattgtataatatcacacattagacctcctaatttattactaaaattatatcagtaaatgaaatcgtccaattctctggtatatttaagaattgtcaacacagaaacagatttaaaaatctcatattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacctatcttgtaggatagctgtgaaagttaaatgaattaatacacataaagttcattaaacagtgtggttgtcagtagtaagctcttaagaggtgttagtattattcaagtatttaaataaattaaatctcagttaatctttcccacttccccaaaatacgattatacacccaactgattcacatagatattatacataaagaagagaggccacaggttcagaattataaaattgccagctgtagctcctctccactctacctttctttccactcaaaaaagagaatctgaatgagagtgatgtcatgtttttatggggcgtaaccttgaatctactcactctgtaaaacaaataaaccattcacaaactccaagactttatccattaattgttagtatcatattcattatgtcatagttcccatctgttaatgaaacatcattgcattgcaatcttgaggttgaaatataaatttaaaagtgaatttgaagctaaaaatgagatgctttgcagcctatagtttacagtgtctaaaagcaattgttttaggtcattagtgtaagtaggccataggtaacttaggagtatacaagtgactgtgctcgaaagacatttatgtagactctgtagattcagagtctacacaataataaaatagggcccagtgatcatattttaagaaaccaaaagaagtaaacattttctaacatatttctcaaactttagtcccttctaatcttttctcccctctgccatcagagtgatgtaagatctgaatcaactcttttttttattgtcatattttattttactttatttttttatttattttttcttttttattattattattatactttaagttttagggtacatgtgcacaatgtgcaggttagttacatatgcatacatgtgccatgctggtgtgctgcacccattaactcgtcatttagcattaggtatgtctcctaatgctatccctcccccctcccccaaccccacaacagtccccagagtgtgatcttccccttcctgtgtccatgtgttctcattgttcaattcccatctatgagtgagaacatgcagtgtttggttttttgtccttgccatagtttactgagaatgatgatttccaatttcatccatgtccctacaaaggacatgaattcatcattttttatggctgcatagtattccatggtgtatatgtgccacattttcttaatccagtctatcattgttggacatttgggttctttccaagtctttgctcttgtgaatagtgccacaataaacatacatgtgcatgtgtctttatagcagcatgatttatagtcctttgggtatatacccagtaatgggatggctgggtcaaatggtatttctagttctagatacctgaggactccccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttgcctgcataaatgtcttcttttgagaactgtctgttcatatcctttgcccactttttgatggggttgtttgtttttttcttgtaaatttgttggaattcattgtagattctggatattagccctttgtcagatgaatcaactcttataactgctctgcttcaaatacttcggacacttcccaatatagtcagggtaaaatagtaacttcttaatatagcatttaaagtttttcttacatttctcagaacaatttttcttggaattccatgtgctagccatatttctaaatgtgccatgcccttcctgcttcctgagtgggttgttattcacgtctctgtcttattcaagaacaccctttgcttcacaccctctcaatcaccctttctttgcctgaataacgtgtatccctatccttcagaacacagtttatatgccatcacctccagaaattcttccctgatctctctaaggtgcctgtcctctgtagttccagagttcatttcatgtattgcctattcattcttctctctctcccttagtgaatttttatattcctggaggcaggagctgtgtctacttaatcttttttctacccagcgtctactgatacatggtacattttcggtacacacccatgatgattgaataaatgcattagtcaaaattagatttcttagtctactgatacatagaactttctcagtacatacatgacaattgaataaaggcattagtcaaaattacatttcataattatcaatgaagcctattttaaacaacaacatataatgttgtatgaataagaaatatctacattgagaaaattgttcaatttcttttaaaaattgagggaatgacaactctcctaaaatatggtcctaaaaagaatttgccttattctacccatgctatgcaaattgagtgctaaaacaaatggaataaagttagatttcttctgagtgccaatccaagttaacataagtactcttcttgagtttccatattgaacatagtctgttcattaaatgtgagatcatcctgagaattatagaaatttatttaaactaatttattttaaaaactgtaggtttgtgaagatactaaaactactttttctcccacaggataattgtagacatacattcaaaatagaagtaaattaatggtaatattagttcttctatttttaattaatagattaaacctttggatcacggcatttctcataatctagcagaaataatatagaaaagacttcataagcagattgatcagtcacgcaggcagtatttaacatatttgtaccactgaaaatacatctgtactgtggaccatgtcttggatgcttttgagagtaaaatattagagaaaatttggagaaaatctggttttatttttacaaaactattgactattgaaagagaactttaaaattcagtcactaacttaacaaaattatataaatttgaatgatgtttcatttttactgaaaaataaaccttgtgctcttgaaaccaacatatcattttgagaaataagtctttactgataaaaacagtgcagaattggatttatcacagatctcattattcaatggtacttaatagctgagaacttaatagttttaagtctggtgtcacttctctggacaaaataatcttaaattcttataatctttcaacttaagtcctttttttataagctttgttttatttccttactttacttttgatccttcccagtccttcagaattttaacttctatatcatggttttactctgccaattcccatattaccttcccaatttaccttgttagtaaatttttacttctttggtctctgaggcaagctgtcttctgaattcttgcccagaaattctaagacttttctaatatattattaaaaatacttgtccagataaaccaatataaatacaacacattaccactgataactctcgtttattaaatacctgctgtactccatgtaaaatagtactttacgaaagaatggctaatatatttgtataaccaattttaagtttaaaaactgtgactcttttttaattttttaaattataaattgtaatctcactttcagccttttaaatataggactttgaatgcagtatagtttatgtatcaagaagtagccagagcaaagacattatcaaataaagccaagtaaacaagactttctctttgttgaaatatataaacctaattgggccatatcagtgatcagttaagattctggattaatcaaagaggctacatgacaattttttaaaaaatcttttctattacttgaaaaaatgtcacccatttctaagacaaatactgtctagttcctggattcttggcatgtaatctaggcttcacgttcttgatgttgtcacccaacaaaataatctttccacaaacatataaaaatatatggagttctcaattttccatggaaatagaatctagggttaatgtggtgaaataattttcattattaacaagccttattttagtatatgtaaataggattagattgaaaagccaagttttatagtaaaagatgtgatttctgtaaaagagagtattctgtaaaagctggaggacaagtgaagcttaaaggagcagcttgtactgatgagaaaggggagaggaatgagtggacctctcttcagagaggaaagaaagataagatgaaaagccagcatgaaaaggaacttgctatttaaaattacaacaaactgtttatgtggaccagtagcatcatgatgtaaaataaattttctttactgctttgccatgacgcttaattgataatacattctagtaagcccaaatttgaatctcttctcgataactaacattcagttaatttcttatttcgaagtgggaagagcaatggctggaaagaaacttcctacagagaaattctgatgcaaatatgtcttgaaatccagagcattttggtccaaatttaacaatgtgtgtcaaattttacaacagcagatgtgaatttatggttctttattaagttttaggaattctgaattgtatttgtctgcttaattctatagtgaaactaaagctcagttaaatagtctaaagaatgttacttaatagtaaaattacataaatatgccatgcacatgttggctttcaacagagtgcatttgaatatattcagatctgtggtgggtgctgaagacttgtctatataggttcagttccataactgaaccagtgagaatctagaaaaccagtgttttcaaaactactccctcatgggtgaatggagcacatactattgaatgatctgctctaaacttaggcattggtgggcctgaaataagacttgggcagtgagcatctgcttctcttcacccaaagagttgaccttccaagactatagaggaagttaaaattaagaaatgagtataagagagacacaagtaggtgacttctcaaattctgaaaagggaagtttgggtaaacaaatctgaaggaagaagaaattaatattagaaaagcagagttaggaagacagaagtgaatcagtaaaatgtcttttgttagaacaggtgcttctacatctgttttgaatcaactgcacaatggtttatgcatgggccaactgaatagaaatactcaaggctggcataaatggatttggttccagttacagatttctttgttttgttttgttttcaaaaatagagcccaattaaatccatcctcattggttgtagacattaccctaaatgtctagtgtgtgcaaatgtttctctataccctaccttcctatccctattccccatgggtccctagcattagaccctgcttcctgacagtctagacttgggcttgtcattataccaccataaattagaccctgcttcctgacagtctagacttgggcttgtcattataccaccataaatatatatatatatatctgtaattgtttccttagtgaattgaaggttttttcatttaaaattaaatttgtgtggaaagtatattctttcccatcaagttaggaatatttaaaagaagtatacatgttagatgcaaagcgctaattcaggaatgaccagataactagtatcattatattctttttccaagtatattccccaatgtttggaatgctgttcttttgatcttaactctttcatctgaaagcacccatcaaaggttacatgagcaaattacccaataaatgttatttttccaatagtttcagcctcaccctacttaaaattatattgaatgttcgtgacagttcaaattgacaaattttcagtttgcctcttctttttaccccacgttattctccaaatagaaatcttgagattttttccacaagataaatctttagaataactgaggactaattatatgttccacagcagtctgtagtagtctcacaggctgagcgtccaaatgaggttgctgctatagggaagggcaggcggaaatagaaataaaataaataatccttcccaccctcacacacacacacacacactcacacacacaatcaagaaaccatcaaacaaagctcagaaacatttcaaacataagatcatcttttactttacttttttgttgcatgtttactttgccttctggaaatattgcacaatctattagctttttctctttagatgtttgaaggatacagaaggtactactaacttaaaaaaaaaaacattgattctcacagcagaacctgtgtgtacttgttcactacatacctacattgttaaatatagttgcttcacaaacaatacaataagaaagaatttaagaaaacagattctatgtaaatagtctgcgtcactaactctattatttagtgattaaacggaaaaatatttagtattgagtgttggttcatcattgttgaatcagtaacggttaccaggatcattgtcaagttaataattgagaccaggaacttccttcttgctgagggcttttagtagtgatcagtggcagagggatatgaaaggctggagaagaaaacaggagacccagtcctgcctttaccagcagccctgagattttggttaatcacttcatatttctgttctgcttctttgcttatacaatgacattaggctacagctgagtgggctcccttccgtgtggttgtgagactttattctactgccaaataaaaataatatttgcattatctctttttttaatatttgcacttttttgttctcatcagtatccataatgaagcactaagcatgtaacattttgcagattgagatttcccagtcaccatgcaccataaataaaataattgagacataggaataaaaatgcattacagtataaacaagcagtaacagagtgtggaaaataaaaagacaaggaagtacaacctctcctctgtttaacactgaacaaaatttttgggagagtataatgttatatttataaatagagcaattagatttggttcagagaaaagaaaatgattaaacctatagaatacagttgttgtaaagaagggaaaagacctggagaaggaagaagtaaaaggtgaattaatagctgtgatgagaacactgatccatgattcttcatctccacagacgactgtcccacaacaaaaacaaaacagcatgcaattgctgaaggaaaaagctagttcctcaaatttgaaatgctacttttgaggaagactcagggacttctacctcttagagtattacaaaatgttatacatataccatactccaagcagagatgttctgctgtctctttaaacttagtttagtataaaaggatggtaaatttggtgataaatttagtaataaatgcaacatttttcttatctgtaacttaataggaataaactaatttaagattccttctgtttcaaattctttatgattttttattttggggatgttggacttgaagcttcactaaatattcggttatagaaatacttttctaggaaaacttattagggttaagaaaccagatatttttcttttaaaaaatatgtaattcatatattttgaacttaataattagattccaaatggtcctaatcacaccctgtggatctttagctcttgaggattcaaaactatgagattttacaatcacgttttagatagtaaagattgaatgagtatgttaaggctttcatgaaagaaaaatggaagaaagaataattgaaacaagtaacttaagtggtgggcaagtaaaatctgtaagccaatttctttgtctgtaaaatgaggagaataatagtatttatatgaattctttgttgaatgaacaaagtgagataatttttggaaaatgatgagcaaagtgaatggcaagtagaacagacttcagaaatgttagctatttattatttacacaagaaaagtggaaggtatggtgtactaaatatgacaaatatgacacattcaaacagaaaagaggaaaaaatttctgttatgtagaaaattatcccactacaattttctttatccttatttattaaaaatacgggatgaaagtaagaaagaaagatacgcaaaacagtgtgtggtatgtttgcttaaaacggaatgtgttttgaaacacacaaaaccatatacctacttgtatgctcatatatacatagtttttttttttttttttttttttttttctaaaaaacacacaggaaccttaataatgggcttctctgaaagggaggcctgcgaatatgagataggagggaagccttcttattttttaagtatatgctttatctgatttgaatatttataatgtgtacattattttaaaataaactactagtgcaaaattagtattattttttattttttacatttaattttattttaagttccaggatacatgtgcaggatgtgcagatttgttaaataggtaaatgtgtggcatggtgatttgctgcacctatcaacacatcatctaggtattaagtcttgcatgcattagctgtttatcctgattctgtccctcccccctaccccctcaacaggtcccattgtgtgttgtccccctccctgtgtccatgtgttcttattgttcagctcccacttttaagtaagaacatgtgatgtttggctttctgttcctgcattactttcctaaggataatggcttcccacttcatccatgtccctgcaaaagacattatctcattcctttttatggctgcatagtattccattgtatgtatgtaccacattttctttatccagcctatcattgataggcatttaggttgattccatgtctttgctactgtgaatagtgctgcaatgatcatacctgtgcatgtatctttataaacagaatgatgtctattcccgtgggtgtatacccagtaatgggatggctgggtcaaatggtatttatggttctaggtctgagaggaatcaccacactgtcttccacaatgattgaactaatttacattaccaccaacagtgtaaaagcattcctatttctccatagccttgccagcatctgcagcatctgttgtttcttgattttttaataatcgccattctgactgggatgaaatggtatctcattgtggttttgatttgcatttctctaatgattagtgactttgagctttgtttatatatgtttgttggctgcataaatgtcttcttttgagaactatctcttcatatcctttgcccactttttaatggggttgttgggtttttttcttgtaaatttctttaagttccttgcagaccctggatattagacatttgtcagatggatagattgcaaaaattttctcccattctgtaggttgcctgttcactctgataatagtttctttgctgtgcagaagctgttcagtttacttagatcccatttgtcaatttttgcctttgttgccactgcttttgatgttttgtcatgaaatctttgcccatgcctatgtcctgaatggtattgcctagattttcttctagggtttttgtagttttgtgttttacatttaatgctttatcatcttgagttaattttgtctgatgtataaggaaggggtccagttttaattttctgcgtatggctagccagttttcccagcaccatttattaaataaggaatcctttcctcattgtttgtttttgtcaggtttgtcgaagagcagatggttgtagatgtgtggtgttatttctgaggcttctgttctgttccattggtctatgtatctattttggtacctgtaccatgctgttttgcttactgtagccttgtagtgtagtttgaagtcaagcagcatgatgcctccagctttgttctttttgcttaggattatcttggctatatgggcacttttttggttccatatgaagtttaaagtagtttttttctaattctgtgaagaaagtcagtggtagcttgatggtaatagcattgaatctacaaattactttgggcggtatggccattttcactatactgattcttcctatccatgagcatggaatgtttttccatttgtttgcgtcctttcttatttccttgagaagtggtttgtagttgtccttgaagaggtccttcacatcccttgtgtgttgtattcctaggtattttactctctttgtagaaattgtgaatgggagttcattcatgatttggttctctgcttgtctattgttggtgtataggaatgctgcttatttttgtacattgattttgtatcctgagactttgctgaggttgcttatcagctttggggctaagatgatggagttttctagatataggatcatgtcatctgcaaagagagacagttttacttcctctcttcctatttgaatatcttttatttctttctcttgcctgatttccctggccagaacttccagtactatgttgaataggagtggtgagagagggcatccttatattgtgtcggttttcaaggggaatgcttccagcttttgcccattcagtgggatattggctatgggtttgtgataaatggctcttattattttgaagtatgttccttcaatacctgatttattgaagggatgctgaattttatcaaaggctttctctgcatctattgagataattattgtggtttttttcctttagttctgtttatgtgatgaattacattgattgttttatgtatgttgaaccagccttgcatctggggatgaagccaacttgattgtggtggataagctttttgatgtgctgctggatcagtatgccagtgttttattgatgatttttacatcagtgttcttcagggatattggcctgaagttttcctcttttgtatttctgccaggttttggtatcacgataatgctggtctcacaaaatgagttaggaagaagtccctgtctttcagtttttggaatagtttcagaagaaatggtatcagctcctctttgtaccttcagtagaattcagctgtaaatccttctggtcctggtctttttttttgtttggtaggctatttattgctgcctcaatttcagaacttactattggtctattcagggattccacttcttcctggtttagtcttggggtggtgtatgtatccaagaatttttccttttcttctagattttctagtttatttgcataacggtgtttattgtattctctgatcgttgtttgtatttctgtgggttcagtggtgatatctcctttatcattttttattatgtctgtttgattgttctctctttttttctttattagtctagctagcaggctattttattattataattattatttaaaaaaaatagctcgtagattcattgatttttttgaagggtttttttatgcctctatctcctttaattctgctctgatcttgtttatttcttgccttctgctagtttctgggtttgtttgctttgggttctccaattctttcagttgtgatgttaggtttatgatttgagatctttctaactttttgatttgggcatttagtgctataaatttacctcttaacactgctttagctgtgtcccagagattctggtacactgtctctttgttctcattggtttcaaagatcatcttgatttgtgccttaatttcattatttacccaggagtcattcaggagcaggttgttcaatttccatgtagttgtgtgattttgagtgagtttcttgatcttgagttctagtttgattgtagtgcaaaattattgtaacaacagtattactaccaaaattgtagacaagatacatcttctcacatagtaatttatttattatgaattgagaaattaggaattttggttatagttcctatgaaactttaggataacagttgtgctcatttttatgtgttgcttgtttcttttccccgttaggcttgcgaatttttttcttatttgttacaataaacctacaaacatattgaaattaaaatgatctttcatttttattgccattcttatattagtctatgtttaagttaaatcacatttaagatgaagttgcatagtttgcttcttgattgatgttttgaagtgatttgcaaatgtaacaatgtaagcctagaggatatctactaaaaaaaaaatcacccaaacatacagttaacagaagtgcaaatattcttcagtagaaataaatttatacatgttatggcgagcaagtatgagaagaaaacataccataagaggaatttaaattttgtatcaataattttttgacactcaagattgttgaaccacacttaatacaatggattattttaaaagctgtggcatagtatttctggagaagtatttcctaaattcttgtgatccagataattagaccacaaccaaattaattttataatggcatatacttatactcactcttagaattcacaatagaaatgagctttgctaactcctggtataaagaaattgtttacattgtttaaccttatgtctgacttgagacatttggaaaaccagcatttggaaagcagtgttttgaagtaaaatatactacatgaatgaaatacagtgtctagatttaggactatttgatgtctggtaccttctataaccataattcttcattataagtcaaaatacaacagaagaacaaaacaaataaatacaaaaagccctattatttatttccatgaagatacatgtaagttttccacatgatttggaatttatattatctaaatttttattttaagctcactcaaatatagataattgcaaatttggaaaagcagtcagtaatatcaaaatactgttattttgtgcctgtgtatttttacaaaatatttcgagtccattctttcaagaggttcacatcagtattcaagtactatggtactttcactagtagccaagtactatagtactttgactaagtatggtaacagcctgtaagcctcctaaagctgaaaagattaaaattttattcttagacaattgaatccactaatacaaaataatttaaagtaatcggttaattttgtttacttcgcattttactttgctatgtgtttccctgacatatgactcactacctatgtatgtctgtgtctgagaaggacatacatagctacgcggaagggacatgcgagggatgagggaagcataggcatgttgaggtacttatctcctgcagagcaaacacgtcatgatctggaaatgactgcatttcctcccacgtgcctaggcttttctgaatccctggttctcttttcaacaggcccatagaaatgtctctgcttctttgttgttatttacatttaccaaaactgcagggatttccttagatgccttccagctagtctggctttataaatcagacctatgtcccaaaggaattttaacaagttttcactatttttgggaaaacacaggacatgtaatatattccataaactactcctgaaaatatttttttaatttcagagttaaattgtgtttagtactacacaactccaattttctcctgcaatctatagatttattgacatctgcaaaattgtttaggcagaaaggtggtttctttttccattttaatattaactgcagccataaaacaagcatggcaaaccaatgactatattttgggaaattttttagataattcagtagcttacacaaattgcctttgttttttctgagcctattatagcagacctgtaaggtttggttgtatatattcattttttctactaatgtggaaagtagttgtagttttataattggtgaaataaaatgcaagcaaggtaataatgactgtatttcacggagtaatttctaactttataactgtaagcacagtaaataaagcatgtacctcatgccataaacttattctcaaagtttatcttaagttaatcaacatgtatgatttgacttttcatcaaatgaccgccctgccaacttattaacaaaggatttctggtattaaaattttttggcagttattttgggcctttcaagatctttccattaaaatatatatttagtgaccacaatggaatatgtttttactcttcaggttgtacaatcttcaatgcaactttttcaggaggatgtttcatacagtgtcactgtaatcctataaagtataatatgaagattcaagagttttttgtccttggagagtacacagaaatagagaaattcacagcaacaaatgagctcttatttcttatatccagagatgttttcttactaaattgttatgtatgtatactcatgtgacatattttttctatttgatgtcaagtgattcttttacatcagctctccattttagattattcccatgaaaatatgcttttcttttactattaagttaaaagcaattaattcaatatgacttatgacaccatgttatttaggatatcttattgcaatgacaggaatcaacaggatctagcttaagcaaatatgggggatatataacgagggaacaagaagtctctgtaacagagctatagtaagatatgcatctctataatgaagctaggacttagatctcaagaacgaatttaaattaagggcatgaaggctatcagttctgtctgtctcaattcctcagctcttctttcttttcatttgccttctctctttctgaagactatcccattttgattctaaggccatatggcagcccatgtctcctggattgagttctcctccatttaataaacatagtttgcctagttctgaattcacagggcaaggtttctgattggcttagcttgggtcaggtgtccatttaggaccagtcaactaacattggaggaggggaatttgataggtttctgtgcaatttcaagaagccttgggatgtgctaataaagtagactgggcaagcacaataataactgcctactatagcattttttgcttaattaaattaatatttattagacactcatcataagcaagttataaccgtggtgctgaataaatgagtaaaatactgtatctatattcaacaattcaaggatgtggctgctgtgcaaatcattggagtacagtgaagacagagaatggagcttagtgatgatcataaggagagaaataggaggtttaggagctaggaggtatgatcttcctgagaatctttgaaatagaagagacctgaatatctgtgggagccaaaaggaaagaaggatcagactcaaagggcaaaactgaacttggaaaagcacagggattgattgggcaatgtctcaaatctggagaaagagacaaaactgagaaacgggacaagattactagaaacttactggacttcttcctaaaaggtagaaacaaaggatgaacaaaagcattagtacaaattgagtttttaagtagaattaatttctagtagatttaatgaagttttggacattcttcagcaatatctactatctaacagtaaaaatattgtggaaccatagcttccctactgcccagtcctctgtctgtccttgatgttcatggtgtcagcgattattgggatggttaactctgcaagtagtatttaggaaaaagtgattgccctcttaaaggttaccatacctttccaaagaccatagcctctggattcatttcttagcagttttatagttcctttgttaaatgttagcatgtgagatagtaatttttcataaaaagcatatgtatacttttaggtggcatgaaagtgttaactatctgtggacttttatccaatttcagcttatggtgacaggtttcctattgtagatgaattgaattaatttttcaaaataacctttttttgcgaggctatatcaattggtgtgctacagttaaaatgtattactttgcctatttcccattttctactaaagtttataattcacacaaagaaatacaataaagtgtgtctcctgaaattgtgctttgtgaaatgatgaggccattactctgccttttgagattaataaatttttctcttggcatttgttcccttatctaactggcaatgtgagtttaagctttacagataaatattatactattgttttaagttttgatttttgtttattccttataaacattacttttgaaaaataaagtgtatcttctgcaagttgtacacatgtatatatgaagtaaacttagtcaaagtgcttgagttgctttgtaattcaaaattatgtaagtacattatgttatgttgaataacaaaaagtgataactctaagtttaaatgggtgactaaatttaaaaaataatttataccaagtatagagataatagatttaaacatatcaatttaaacttatagctatcacttcttgttatttaacataacataatatattcatgaataggtagtagattccatttttcatgatcaagctttcctcaaataaccctccctccaattttcaataacaacgaaacacaacaaattaaccactcatccagaaattctaaactatttacgtataatgattgtcacatacctttttaaagaacactttgttttccaaatataatttgactaaatgcaaataagaactgaaccaataaaatgaagcttttaaaaaaattgaacttctgtttgataaatggaattatttatttgacaacactaaaaatatgtaaaataatgctttagaatatcattttaaatccactttttaataaaagctttcttaactaattaattcaacaaatatttgttgagtgactaccatgggttagctactgtgttaagttggatgctagggatgcagtgataaagaaaacatggtcctatgaagcttttgttttggtggaatggtggttcttaaacttgcacgtgcctctcaatcacctggagagtttgttaaaacataggttgttgggcttgacatctacagtttcagattcagtatttctgaagtggggttccaaatttgcatttctaacaaggtcccatatgttgctgatgttgccagtcctgggaccacactttgagaacagctgtcctagaggaggcagtgctgtctatataccaaaacttcaattagcctatgctgtgctgacccatgcatgcccactgcagctccccctctttcattttttttcagaagaaaaaatgctttctgtaaatacaatctggtatgtggatagtgcacaaattatatagttgcttcttaaattactgagaaatttacgaggtcaagtaaatataattttcagagataatgctaccttatttagcctagtgaaaatgtatcatcagtattatggcctgattttcaatttaatcatcactttattttaacataaagcttttctttctgatcttttggtagccatccagttttccatagtcttttaaatgtgatggccagtggttcatttattgcaataattaagatggatagcagcatgccagctggaatgactacacttgtgtttattgtataaattatttccttagtataaaagcctcttttatggcttttgctttggtcatatcttttgtaccctaaaccattaaccatagcatgtttaggagagccatttataaagaagctggtaatatttaccaatttctaatcaccattaattcatgtctacatttttcttagcactggagattgcttgttgctttgttccttctgccaagagcaagaaaaaaaaagtgttctaacccttctaggactcataagcttttttttttccttttcttccttttctttgatttttttttactacattcacacttcttttattttgttctactctcatctcttttccttgtgaatcttaagttactttggttagtttactcaaaatacatagaaatgcagcccctaatgtgaatttcttataaggcatatttgaaattcctttaaaacacagactgcaactgatttttgtcatttttttaaaatgctacttgagtttggtggtcttttgcatttcaaaaataattgcatttcagttttaacagaaattattcagatatagttcagacactgatcatttctgtatgcatcatcgtacccagcaaatttcagtaaatatttgctgacctattttttttctttacactttagtttcaaggaaattgcatgcctgttacctttctaaaagctagtgcagtgattgttggtatatttacaatactcatctttccttttaaactttgtaagtttgaaagtataaatcaaaatgtcatattacatcagaatataaattttattattacccatatatcaaataactagttaaagcaattcagagtagttaagagggaatatttagtggcaataaatgtatattgttgcatataaatacacatattaggcctagatttattgtctacaattcttttaatttcttatcagatttcagtatgaaaaaaagtgaatgaaataagcaaaagactatatccagttactgtaactaatgctaatttcataatctcttaatggtttaatgttatatcctgatggttttatgttttttgaccaatctttcaggctatccttttctgaccactcaaaccatgaaaacctgccctccctggaaaatccaagagccagtcagttcccacaaagacaacaagagccactctgtttggaaaactttggctctttttcagcagtcaccattggccttagaatacagagcattcttacccactggctaagattaacttggttagcagacagcctacatcccttcgtataaaaactgttcttaaaaagtagcaaacattgtcctaaatttccttaccccatccctgactatcatcacctactttctgtcactgacttgttaatacctttattgttatatacagattttataagttgtccctacctgtttttaaataattgaggttataagcataatagttggaagggttaactacgttgtcctgttaaggctgataaaagggcatagatgcttttaaacatacacaggaagaatgagaaaagcagatagcccttgtttgggtcattaagaagatgataaagtatttttcttatagcatgtttgtgggtaaagtatttgaaagcttctaatctgccattgataaaacagatactttactattaggttttgaaaaatgccttaaaaaaatctgctgcaaacatcatttaatatgtcatttaacttataaataataagcagaaacctaatatcttcatttttgcaggtatgaaatattgtaaaagaaatgtaaaataaattttaattttattcattgatactgtgaaggagaactttaatagactgagcataatgtatcatttgcatttatataatgattttaccactgtcattttagaatactataaatttagaagagtaatacagtaataataagaatttttaacattttttagtctcaggttcagagatgagtaaaagaccctcaggacatacgtaaagagaagaactctttctagacagaagtgaagaaatactaaacactcaagtgtaagattccctgaagatggaatgatggtagttgtgttggaagtggtggtgggatttgttggttgagggaagagaagagaaactaatctattgttcagagatggggttaagtagaccagggattagatttctactcagttaccagctagtcatttgccgttgagaaagttacatcagtctttggatactttaattcccatctgtaaaatggggaaggtaatacctgttttataaagttagtggcataattaaattttaaaaatgtgtattaaagcattttgtacacaaagtaggcactcaagaatcgaactattactaaagactcttactattaaagaaaagcaaaactgtattataaaggaaaagcaaacaaactctggacaatcagaattataccagaagtgtattttccatggaagttgaacctagattagtgcataacaaggaactgctacaggcattgatcgtttcttagaaattggctactgattccacaaggaacacccacaccttagtagctgatgatccccttttgtgtggaatagaaataaatgtaagtagacaataaataaaaactgaaattatgtactgtctctgtaatttacgtctagtatttgaaagatcaccactgaatcttacgaattttgctgactcctatacacaactacttgggaagtttccttaggggctgagacacaggagcagcacagtagaggagcagtacaaaatgttcaggagaagataatagtcagatagcattgtcacaagaaatacgctgtattttccactaagctcatggttgctctcagtgcggttgtttattcattcattcatccagtaaatttttatcaagtgtttatatgttatcagcatggaactaccaacacctgaaaatacaataatcactaagatagatagagtccttgcctttgtagaacttgtagtatgtctaaaatttgttttaaatcattctgactcttttagaaagacttcttcatattaagttgaagaagttgagtaaagttgccacccccatagtatagcccttttaatgaccccgtctttctcattattaaggaatgtccatgtgacttaggtgttctgaagcaaagtaaactcctctagactagtggttttcaaccctgactgcacttaggatcatcttggaagttttgaaaatatgaataattgagtctaaccacagacaatgaaataagaatttctagacttggggctcaggcattagtattgtttaaaagctttagaagtgattctaatgtgtagccatgattgcaaacgactgcttgaaaaaaacagagaagaaaaatagcaacttggggtagtgaatgatgacaaacaggaagcaaagtgagtgatagaaataacaatcatgaagctttaccaaacatccccatcatagatgtcaagataaggcttatacagaaagtaaataaaacagcttactcttagataatatagtgatttcatttatactcaatggaaatattccatcaagaaatgtgccaaatctagatactttgtcatattattagaaatgtcgatattgcaactagaagatgttggataggaggcaggactagcttgtggctcccactcagacagacagagcagtgtgtggagattcattgtgaaccattgctccaagaactacagcaggaacataccaggaaagcagagagaatccacagaccctttgaaggaactgtatcactgctgcaggctccatgagatgctgaaaaactgtgagtcagcttgctttctcaatggggagtctcgtggtttggggcaaattctcagccctggtcacctgctgcatagaaatagactcggtgctgttggtggggcatggtgggagtgagaccggcctttaggtgtgcaggctgcatgggagcggggtgtggcccgtgactgctggctttctcccacttccttggagacctgtatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgctttttttttttttttttttttttcttaaatggagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccggagcaggctgcgagacctgaaaacggatcacatcacaagactcattgcagacactccccagtaccagcctaagctggtagctccactgggttgccagacctagaagagcaaaaacaatcatgacggtttggctctcaggaagccccactcctaggagaagggggagaacaccacatcaagggagcaccctgtgggacaaaagaatctgaacaacagcccttgaatcccagatctgccatctgacatagtctacaccaacgaaaaggaatcagaaaaacaattctggtaatacgacaaaagaggtttcttcaacaccccaaaaagatcatatcagctcaccagcaatggatccaaaccaagacaaaattctctgaattgccagaaaaagaatttagaaggttgattattaagctaatccaggagccaccagagaaaagtgaagtccaacttaatgaaataaaaaacatgatacaggatatgaaaggaaaattcttcagtgaaatagatagcataaataaaaaacaatcacaacttctagaaatcaaggacacacttagagaaatgcaaaatgtactagaaagtatcagcaatagaattgaacaagcagaagacggaacttcagagctcaaagacaagtcttttgaattaacccaatctgtcaaaaacaaagaaaaagaatggaaaaaaaatgaacaaagcctcgaagaagtttgggactatgttcaacatccaaacctaagaataattggtgatcctgaggaagaagagaaatctaaaagtattgaaaacatatttgagggaataattaaggaaaacttccctggaattgctagagatctagacatccaaagatgagaagctcaaagaacacctgggaaattcgttgcaaaaagatcattgactaggcatgtagtcatcgttatctagtcaagacaaaagaaagaatcttaagagctgtgaggcaaaagcatcaggtaacctacaaaggaaaacctatcagattaacagcacatttctcagcagaaaccctacaaggtagaagggattggggtcctatttttagcctcctaaacaaaacaattatcagccaagaattttgtatccagtgaaactaagcttcataaatgaaggaaagatacagttgtttccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaacaaggtatttaggaaaaaaaatagcacgatgaatagaatggtacctcatatctcaatactaacattgaatgtaaatgacctaaatgctccacttaaaagatgcagaatgacagaatggataagaagtcaccaaccaagtttctgctatcttcaggagactcacctaacacataatgattcacataaacttatgataaaggtgtggaaaaagatattccgcaaatggacgctaaaagcaagcaggattagctgttcttatgtcagacgaaacaaactttaaagcaacagcagttaaaaaagacaaagagggggcccagtggggtggctcatacctgtaatcccaacactttgggagaccgaggcaggcagaccacttgaggtcgggaattcgagaccagcctgaccaacatggagaaaccttgtctctactaaaaatacaaaattagctgggcgtggtggcacatgcctgtaatcccagctacttggcaggctaaggcaggagaatcgcttgaacctgggaggtggaggttgcagtgaaccaagatcatactattgcactccagcctggacaacaagagcaaaacttcgtctcaaaaaaaaaaaaaaaaaaaaaaaaaaagacaaagagggacattatataatgataaaaggactagaccaacaggaaaataccccaattctaaatacatatgcacctaagagttctcaaatttataaaacaattactaccagacctaagaaatgagatcgatgacaacacaataatagtgacggactttaatactccactgacagcaccagacaggtcatcaagacagaacgtcaacaaagacacaatggacttaaactatactttataacaaatggacttaacagatatttacagaacattctacccaacaactgcagaatatacattctattcatcagcacatggaacattctccaagacagatgatataataggccacaaaacaagtctcagtaaatttaagaaaaccaaaattatatcatgtactctctcagaccacagtggagtaaaattggaaatcaattccaaagggaaccctcaaagccatgcaaatacatggaaattaaataacttgctcctccatgatcattgcatcaacaataaaatcaagatggaaatttaaaaattcatttaattgaatgataatagtgacactgttcccggaccaaactgagggttgggctgttatttctcacagccccataatgagatgcagataaactggggaggaagagagtttttatttctgtaaccggttacagggagaagacctggaaattatcactagaccaattcaaaattataaagttttccagagcttatatactttctaggctatatgtctatgtgtaagtgtgcattcgcctaaagacacagtgatcaacttcttttaatctgtaactaaggtctgagtcctgaagaccttgctctggagcctcagtaaatgtcttacttaatctacatgggtccagatactggggtaattacccttatcttgtctcctgctaaatcatggaggtttgaggagttcttcagacccccaataaacttgtttgtggaggtctgggaagtttctttagacccacaataaaactttagtcctaaatgggtcctattaagaattccttcgttattttgtcatgctttaaggcccaggaaaggcctaggcaaaactcctgatgggctttttgttacatcccagccattgtataagggcactggcttttaatatttaacttaaccactcagtcaatactgaaacagctgttagtgagagctgacctaccacaacacaacctatcaaaacctccgggaaacagcaaaagtggtgctaagaggaaagttcatagcattaaatgcctacattggaaagtttgaaaaagcacaaatagacaatctaaagtcacaccttatggaactggaggaacaaaaacaatccaaattcaaactcagccgaagaaaagaaataactaagatcagaacacaactaaatgaaatttaaacgacaacaacaacaaaaaacaataaaaagataaatgaaaaaaaaaaactggttctttgaaaaggtaaataaaactgatagatcattagcaagattaaccaagaaaaggagacagaaaatccaaataagctcaattacaaatgaaacgggagatattgcaactgacaccacagaaatacaaaaggtcattcaagacgactatgaacacctttacgcacataaactagaaaatgtagaggagacgaataaattcctggaaacatacaaccctcctatattaaaccaggaagatacagaatctctgaacagaccaataacaagcaacaagactgaaatggtaataaaaagaaaatgccaacaaaaaaaagtccaggaccagatggattcacagctgaattctattagacattcaaagaattggcaccaatcctaatgacactattccaaaagatagagaaagagggaatcctccctaaatccttctgtgaagtcactatcaccctaataccaaaaccagagaaggacataacaacaacagcaacaacaacaaaaaaaaaacaacagatcagtatccctaatgaacatagatgcaaaaatcctaaacaaaatgctagcaaaccaattccaacagcatatcaaaaagatagtccaccaagattaagtgggtttcataccagggatgcagggattgtttaacatacataagtcaatagatgcgatacaccacataaacagaattaacaacaaaaatcacatgatcatctcaatagatgcagaaaaggcatttgacaaaattcagtatccctttattattaaagccctcagcaaaattggcagagaagggatataccttaaggtaatgaaagccatctatgacaaacccacagccaacatcatactgaatgggaaaagttgaaagcattcccccagataactggaacaagataaggatgcccactttcaccacttcttttcaacacaatactggaagtcctattcagagcaatcagataagagaaagaaataaagggcatccgaagaggaagtcaaactgtcactgtgtgctgatgatatggttatatatctagaaaatcctaaagacttattaagatcctagaactggtaaatgaattcagcaaagtttcaggacacaaaattaatgtacacaaatcagtagctctgctatatactaacagtgactaggctgagaatcaaatcaagaactcaacctgatttacaatagctgcaaaaaataaaataaaatgcttaagaatatacctaactaaggacgtgaaagaccttacaaagaaaactacaaaacactgctgaaagaaataatacatgacacaaacaaatgaaaacacaccccatgctcatggttgggtagaaacaatatggtgaaaatgaccatactgccaaaagcaatttacaaattcaatgcaattcccatcaaaaataccaccattattcttcacagaactagaaaaaaaaaacttaaaagtcatatgaaacaaaaaaagagcccacatagccaaagcaaaaagaacaaatctggaggcatcacattaccctacttcaaactgtactataaggccatagtcaccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtggaagaatgaaactggattctcctcttaccttatacaaaaatcaactcaagatggatcaaagacttaaatctaagacctgaatctatacagattctacaaggtaacataagaaaaacctctctagacattgagttaggcaaagacatcaagaccaagaatccaaaagcaaatgcaacaaaaacaaaggtaaatagttggtacttaattaaactaaaaagcttttgcacagcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgtacaattgaccaatgagcataaggaaaaaagctcaacatcactaattatcagggaaatgcaaatcaaaaccacagtgcagtaccacctcactcctgaagaatgaccataatcaaaaaattaaaaaataattgatgttggaatggatgcagtgaaaagggaacagttttatgctgttggagggaatgtaaactagtacaaccactatggaaaaacaatgtggagattccttaaaaactaaaagtagatctactatttgatccagcaatcccgccactaggtatctacccagaggaaaagaagtcatatgaaaaagatacttgcacatgcatgtttatagcagcacaatttacaattgcaaaaatatgggaccagttcaaatgtccatcagtcaatgagtggataaagaaaatgtgacatatatatatatacacacacaccatggaatgctactcagccataaaaaggaaggaaataatgatattcacagcaacctgtatagaattggagactatcattcgaagttaagtaactcaagaatggaaaaccaagcatcatatattttcactcatatgtgggagctaagctataagggtgcaaaggcataagaatgacgcattggactttggtgactcaggagaaaggctggggaatggcaagggataaaggatgacacattaggtacagtgtacactgctcaggtgatgggcacagcaaactctcagaaatcaccactgaacaacttactcatgtaaccaaacaccacctgttccccaaaacctatagaaattaaaaaaaaattaaaaagaaaagaaatttcctgtcctaacaatcaatgaattattttatcatatattgccaataggagctaaacaacgagtttgggccagattgatctgtattttctaatatactttattttttagagatgttttatattcacaccaaaattcaacaaaaggtacaaaaatttcctatatatccccttttgcaacatgtgcatagccttctccattatcaacatgctccatgagagaggtactttgttacaactgatgaccccagcgttgacacattattatcacccatgatccatagcttacattagggttcacgcttgctgttgtacattctgtgagtttgggaaaatgtgtcatgacatttattcctatctttaaaaataggagtaccaaccggaacttgaatttggcccttgtatctttacagtgctggttttattttactctcatagtcatcttttgatgctgtaacagaaccacctgactacccatactatttgtaggttgtctccaagattgccaatatgggtcacccagaattagcacaatgggaaaggcaggttggctaggccaccttaataaccacaaagacaaattgtcttaaattagaggaaaaaaggtagtgtctaccaagacatctaccgtaaaatctatctgaaaattagaattggtttaaggtgaagtaagtcagaagagttaatgtccatttcttgttcatgtacgtgtgtatgtttgagtctttatgtagtaccactctgagtgtttatgtagttatgtggtactacataaatactcaaacatatacacatacatgaaccaccatgtaataccaccgtattgtctgtatctccggggatataggctttgctaacttgttttatgatccactgttgatacatttgtaaatctaaatgctaactcatttattctgtttacctttccgaggcaggcaggttcaattgacttaacagcaggctagcaactcagagactgtgaaatctaatcacattttgacccattcttaaattgcttcatctgtgaaaaaatgtttgatgaatgcagtactctcttgtgagggtttgtatgaagaataaatattagaaatgattgtggggcactttgaaaataaaaattgttatgaaatgataattatattcaaaacaccctttgacatcaacttacagaggaaaaagtgtaatttttcccattgtagacctttttaaggaattccatatttggtttatccctagaattttctatacttgtgtataccatacttctcctaacccattaatggagttgttaaacatcatataatattgaaagatatttctattagatgagctttcaattattaatggtaatggaaaaacattaatgcagctcttacaacatgacagactgtcagaaagatctcaggaatagtgaagggccagagatcctagagtccctgatctgtataaatttgctgcagtatctttataaagtggataataattgtgttagagatcatttgatcagggagaacccagctcaactgtgcaattcagaagagctgggagttaggaggaggttatcctcaatatattaaggcattccagttcacttctggatgtcccacttggtaaaagaaagtacatttttcattgcatagtagcagcatccacagcagcagaagtagcagtagaaatagcagtagcagtgatagtagcagtggaagtggtagtagtagcagcagcagcagctgggataataggaatagtaacaatggcatcaggagcattagctaacattttattaactgttactatgtggcaggcactgttctaacctctttacacgtttccattcatttaattttcataacgctctttgtaacacgggtaattcccatcttagggaatactgtctatgagaatattattcatcaaaaatgagcaaagggacaaagggagaatagatatgcagtgctcaaagtttagagatgctgtgtagtcatttgaagagagctgaacaggacttcttccagcctaaaagacaacagaaatcctcaggtgactaggcacctgctgccatagatagcttctgatgttggagagaacacagagaaagctctacagtcctctgtgtttaggatcccataacctagaaaagaagtataacctaaaattaaggaggagaatatttttattctaaagatgaaaagtataagaaatgatttaatcacatataaaaaatttatgttgtaaacaggagcaaaggcgaaaaaaatctcatactgataagggcatttttatgaactgaaacaggttgctgaaggaggaaatagaatcttttcccctagaggcatttaatgtcaggactaatagcatcaggataaaatgctataagtaaaaccctgagaaagaagggataaacctctagagtcattttcaggtctatggttttataaagtaattcttaaatgtttaatatattagaatgggaggaatagatctatgtgtccaaataattaggacattggtttccttcaggattctgtcttaataaccttgaagactgtggtgaaacaaagaacatcaaggtcaaaaagaattagaaacaaatgtgctttattctcattgtgaactgatatgatagataatacttgagctatataattataattaatttgaaatgcagtacttgaaatttaagcagatgtattcctctcactgtaacactgttagaggtaaaataaaggagaataattttatactcaaatctagtaaaattagcgatccatatggacttcattttatgcaaattattaatcttgtatttgcacttttgcgtttgggaagtagaagaattgtaattcagaatcggaatgttgaaagtgtcatattgtttcttttacacgtgagatgatttacagttttaagtgttatgctcttcagaagaaaaacaacttacattgagccccagaagtcaacatgaggagaaagcaaatgacgttttgtttaacttaagaaaaagttttcctagccacctaattttggaaaatacttggaatatgtgtgaataaaaatacaaaatacataatgttcatccaaagggcttaacattttatattagatacaaaataagaactgatgggtgtgttaataggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcaggtagacccagttctaaacaaaagttctaccaccaactagcatagtgacacgtgaccttgtacaggttagtaacatctctaagttctccatttcttcgactgtaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacattttcttgtaaataagaatagaaaatagtgtctccatcttctctctacacatttgcacatctttccaatcttacagacctgggtgattgtgctgtaggctagaatatgcgcagactctagtcaaacatacttgatatctacttcctcctctggtgcatagtagatggatgtgggataagtcacctagcccatttctgaacttcagttgtaatctgtaaaatgagatcattgatagctaactaataggttgcttggaagtacagatgtaacaatgtcaagaatctccatagttgacatagaacagacttaatactgaataagtaaagtgtccacagctgctgttattgcaatgtgtgtttgtccattagaggcctccttttaattacactttctttcaattaaataatgcaaaataaggtaattagaaaatagtatgtttaatgtttttgactaaagttttgcactcactaaatggaagaataaataattagttaggcctaatatggtcatgtgccatgatgttatttatcaaacattatttagttccatttagcaaatttaatgcctactatatgcaaaacatcatgttcaatgctggcaaagggggatgatgaatgttaataaattagatatagttctgctacttagtgacttaaaatccagtgattgacagaaacacagaggttaatttacggttgtcagtaaaagtatatgaagaaatgcataaatggtcgagtgcagtggctcatacctgtattcccagcactttgggaggctgaggctggcggatatcctgagcccaggagtttgccaccagtctgggcaaaaccgatggaatgatgaaattccatcttacaaaaaaaaaaaaaaatgcagaaattagccaggtgtggtgctgcgcacctatggtcctaggaactcaggaggctgaggtgggaggattgtatgagcccagaagatggaggttcagtgagccaagatcatgccactgcacttcagcctgggtaacagagcaagaccctgcctcaaaaacaaacaaacaaaaataaagtactgtgagatagaataggaaactgtgagatagaataggaatacaggattgtctgaatggagtgaattggaacgcctccttatgcaagtgacctagaaaggaagaggaggctgctatgaagtttaaacgctctctagaaaacagcatgaacaaagaaagacttggatttgagaaagctcagagcatgttcagggtactgaaatgtagggtgctggtgtgcttatatgtatgtgcagttatgtttatttgtgaaaaatgagctaagggtcagaatatagggggacataaattttaaaagcataacttataattatattgaagaaggacttgaattctaggccaaggtgtgtgatcttattttgtatatattgggaatacatcaaaggcttttgaccaaggaaatgaaaaaacccaatttttatttgagaaagataaccctgatgccattgtttaagatatgtctgcagagagtgagtttaaagctgggagagcatttaggaagctaatgtgaagataaggggaaaaagcagatatcgtctgacctagagcctcagctgtgaaaatagagctgactcaagagatctatgtcagcctggatagtttggcctcctctgttaaacagtgtttcgaatgacttgtaagtctagcagcctgaacatgcagcgtagtcctttttagagcacatgttggaagagttgatagatgtccattttcccgtgcttatttactgaaagactccaggaaaggtacctcaatttgctttctctgtaaacataattacttgctttcatccctttggtctcagagagttttaaggattaattagttgagacgaagtgcctcaaaaagaacaagtatggaacatatggttttcctgatacaaataaatcttatagatgcgtccatgctgtctttggaagcccagcaaataaaagacatgcaaaaattgtgtaaagtagaagataagctgagatcaacaaataataaatccccagcattagcttttgcataggaaataaacatttctgtccactgacaacagctttcttttaaaggaaaacaacctgatgatcagccccaaggccacattaatatcagccaaagaaacatttattggttctcttctggaaaccataacaatgagcatgttgcatcaaattggtcacacataaattagtttttttgaatcgataaccttttatttatttctgttaaagtgatatatttttcctaaaatatttgttttctttctgtgccctctttcttttcaagttacctccacagatttatgtcaaaatattatgttcattatacttttgctagtggcttgctttgatgcaaccataaatgaatatcattacactttacaaagataatttattttctaggctttgctgtcatgctatatgtagcttgtatagttaaaacatatagaaactaaaatattttggggcctaaagaaagtttattattttgtttttggcttttcaaattgacattctccattgtatctctataatttaaggcaaccaggtatgacatgcgcaatttatttgctaagacaaaccagatatgctggataaagctctttggggcagtcttgcaactctctccttgtccccaaattcagcccatttttattagcttctatctggctcctgattctttgctgcatctgtcattctcaacttgactttgttctttctcttaaggataaggataagtcttaaggataagactctccttatcactgtttacattgaaggatacttagtcattaggatgtctctgtaagactttatacccttaagggaagactttaatgtgcctgaagctgtgtttttccaaatgtaacatttaatatctccttaacactcttttaatacaccctatatagttggcattgctacattccagctatgtgatattggtcaatttactaaacttttcagttcttaatttttctacttataaaattgtgataataagaataattgcttcagagcattgttgtgagaaaattatatataaaatcacaccataaataatacatataatatacttagctcagtttatggatcacagtaatagttcagcaattgcatattattattattgataatagtaaccgttattatgcaattgctccgtattgctcctcatcctgtgttcccattcttgataaatgttaccaccattcgaccaatttttagaccaatgtcctgaattatcattgacacatcttcactcatcttatttctatgcattgccgtattcttaagttcaagccaccatcatttcttccttgaattactgataacttcttccttgaattactgataaatgttaataaattagatataattcattttcataattccttgaattactgcaatagctaactcatctccctacatttcccttgcatactgtgcaattcatactcataatagagctggagagaattttggaatatttaagtctgatcatgttacctcttacttaaaatgtctcagtagcctctcataacttctaatatgaagtctaaaatccttgatatgagctataataaaagcccagcatgacatgtcctttgcctaattcccctgtgccattcatctcctctttatcacctttgtactcaagctttggcttttctgaactttccttattttcaaaaatgtctcccagccccacttccacccgagacattcacacaccccatttcctcttccaggaaggctcttatgtcgcctgggtaaacttactcttcaagtctagtgacttttttccagaagctttcctgatatctttccatttcaccccactgctgacttattaaaatttctagaattttatacttttacactacattctctgtgttgtattctcttattcagggtctgctatttaatttttaagttccttgaaaatagagacaatttcattgttttcatcagtttggtccaagtatatataacatagatgaaaaatagatattttgtattatatatattatataaataattgttgaatgagatgaataaactatagtgagaagatgctaggctttgttaaccattcaaacctaagctcaaatcccagcgcggccacttgctacctctggtactttgaacaaattctttagccttgtttctttgattttgttttgtttcagtcaggaaattgtaagataattatagtctcctcattattcttgtaagagtaaaataaggaaacatgggtaaagcacttaacatagaatatattttctataaattttacttcctcttttttttcatttataaagttgttcttccaaagtagtagtattaacattgaatagtgtaaagcattcatgccattttattgtatcttctcttaggacatacagaagataatttggtccctcttgtcaatattcttggagtgattgatgacaaaccattttagtgtccctagaaatggaggacttactgcccctttttttcaaaaatgaatattctttttttttggctataatctgaggaggagatgcagtgatctaaaggtaaaagtatcagaaaaaagaattgtccttttgctgattgatttgagggatgtgattatgtagtacattgatgctgactcaccctgagtaaaaaattcgttacattctcatttcctcctactaatatatggctgtggtctttcttacaaaggcctttaaattcaccaagtataagctctaatgaaaatcttgtgtatttttaaaatgtctcttacttgatatgtaaaggaaaacagaacaaaggcattgaagaggtaactcttttggttttaggaatattaaaatgcaatcttcaccagctgtccatttttaaattagatttcagtttttcacatggggtactgtgtgtgttggttagcattggagtaagaatttaaattcttaaaagctttgaagttaattctgtattaagaaacaactgagaggttgagtatggcactatttcttcctgaatctgagatcaagcagatgtgcctctttcaatcagtttttactaccatgagatttaaagcaaagaaaaaaaaaacagttaatgacagttcaaattcacttagtagagtaacgtgttctaaaatggaggattgtaatggttgaagaattgggttatgtttttctcttggtgtgtgtcattttgtattgttttgtcttgccactaagttaatttgatgcatttccctcagaaattggggtagtggggtgtttacatcagaagactatgaccaaagtaaaatgaggggtgaaatatgcttttaaaaatatagagcaaaagcagtgattgatactatagatcttcaattttatcttcaggttctagagttttccagatattcactgtagaaaaaaaaagacttctggtcacaaattctgttactttcacaccaaaccccaaaacatttcaccgaatttcttatcttcctactctttcatttctaccattttctttctttcttacaaataaaccttccttatcaaatcccattttctgtgctttatttgagcaattgatacatcctactttctttagatatcattttcctttgcctccagatacaactgcatctatggggtctctgatttttatagcttgttagaagaagatgctgtattatataggataaaaattattatataatacctatgtatacaaaataataaattcccccataatttaaaaataatgtagtattatagtttaaagttaggttctcttcatctacttcctgaaactctacagtgaggccaaaggaattgaatttaaagaataattctggaatgtctataagttaaatagacgacttgatttctgagtcacgttcagattgacgccacttcttttcattgctgcatttgagaaaatagtgtagaaacaggtacattctgactatataagacataactaataaaagtgaaaacaaagaacaaaagtcagggaaacactaatggttctagagcactaatgggaaaatgaggaagtacatcaagaaagggctaaactgcattcaccttgacagctggtagaggtgatacgccaaactgcattgcagagaacatagcaactgcacgatgtttcaacagtcattttgacagggaaagtccagggacaaagaaggaaaatgaatataaagagcaaaattttgttaagccttgaaacagaaaaatttcccatagggaattttttaaaaatatggcagactagaaagtattagttgtcccaaaggagtcttatttttccaattgaagtagctgctgcttatctgaaacttaacagtttgttgtggccaaaataagcaggtggttataagaaattaaatttccctggagaatgaataatagtgacatacaagtaattataatatcacatgattcacattctgaagaaggtcaaataataaacatataattcatttccatctgccaacatgaatatttgttgagtgcctactgtgtgcctggcacagctagcttcacggttctatctggatatatagatggaagacgggtgagtcagagaaagagataaagactttttatatatacaagcacaaataaaaaaaccgttttggaatttttgcagaattgcaaatgttacttcatattttaaagtcaaaaaaatagcaaatataaaacacttaaaatttttttctaaaaggtagtatttcaattttaccatagagagatggttgccttatctaacatctcgaaaagagccaccctttgatgttcctcttcctctctctcttcctttctctctttatccctgtcttctacacctttattaaaaaaatggtcttctcagtatttttaatatagaattctgcaaatgaaataaagaacattacttatgtaggcactgaacacatttcaatgtttttctttttaaagaaaatgacaggttctgcacactggtatctactaaaaatgaacccaactttgcctctgagaatgttactgtgaagaaatgctgcatctaaacttcagccaaaatatgctaattagaaaatgaagctgaatgaattgctttgctagatgagattatttggaattatattactgaattttggaaattatgtgtcctatcaaagaataacttttgtcataatatcttccttagctcacaggacatttattaatgccactcctggtccagtcagttcagccaccatttagagaaagtctaccatgttccaggcagctaccagcttctaaagatctagagacaaataagaaccaacttttctttgtttcacagagtagcacagatgacaggcatatttacacctaattataatgcacagagattgagggttataatggagatattgctatgggaacaaaaatgagtgaacaacatatcttggtggaggtgcagaaggtatatttactgaagagaggaaagtaaaaagagggagatttgtaatctctgaggaagagtattcaagggcttagacacagtttggttgtattttaagcaaggaaatcaatgatggattggtaaaaagttaactccggggcaactttttttaagcattggtaacctgtgagaaaatgatctatagtaaatatttctttttattcctcaggcagtacttaaagcactgtttttaggagttagatgttttccttatactacttttttaatagtagtaataaccctctcaggtaagagttgttaatttttttgtagagatgaacaaataggttcagagagaatgagcaagtggttccatttacacagttaataatcaccaccaattgtctgtctgattgaattaaatataagagggaaacatatagaaatgaggagataaattgcagccttgatagaaaaggagaattgtgtttgtgctatggttcttttgtggtccatagcaatttaattctttgtgatgaacgtaacactgataataccaaatttcaatgaccacatattcaattcataataaacatttattataaatgccaacaaaattggtaatttaaagaattctctatttttaaaaaaagaagacaaatagattacttttaattatatctagtcttttcctcagcctgttctattctgataaaggcttaagaaggaaatggttctgatagaaaagaactaccctgaaatgtggattaagacttgtcacccatagaaatcctaggttccacagctgtgaccaatccatggcattcaaagtggatctctcaagaagaagcactgtagttaagaaaatttctaaaagaattttgttcattcttgagtcaaaactttgatgagattaaaacattttgttccacttctggggtctcagtgttgaacaattttagcctctttaagatgaaaatacttttcttgaggtttttaattttttttttaacttcaatatcttttggggtacaagttttcttttttttacatgggtgagttacataggtgaattctgagattttagtgaaccagtcagccaagtagtgtttattgtacccaatatgtagttttttatcccacaacccactcccaattttcccacttggagtcttcagggtccattatatcactctgtatgcttttgcatactcacagcttagctcccacttataagtgagaacatacagtatttgagtttccattcctgagtgacttcatttagaataatggcctctggcttcttccaagttgctagtaaaaacatttttacgttgctttctgtgggtgagtaatattccatagtatatatataccacatttcctttatccattcatgggtcgataggcacttagggtggttccatatccttgtaattgtgaattgtgctgctataaacatacctgtgcacatgtctttttcatataatgactggataaaagtactttaaaacaactaatgattccaacattatttccagtggtactggtaatgcattcaggcagaaatttttttttactcctggatttttatctgaactaatgcactttttgtatgccaattgccaattaaagtttctgattttttgcattgcccctgagatattttatagccttgggcaaaaaagtgtactcttccagaccacaaagataaatggagaaaatagtgcctttccttaatttatggcgctgttgtaatcatttaatgtgtgcaacatgctaaatgttgtcattatggtacagtattggatttctttgttgtattacggagcagaacattcaataataataagatagaacagctttttctaacaacttgtgttcaagccactgataataatgaaattatgccagatgaacttattctccaacctcttcctgaagagtcagtgggatacaaaatgtttgagtgaggaaaagcattaatggacagaaggaaagtgtagtcattactctggggaatgacatagttgaacaactgaacatgcttttcagaaatgattacactcataactatcagttgtactagttcggccttgaaaatacagtagctatcccattttacaacataatgtatagttatgtcatataattttactggaatcttctaatgtaagttcccattgttagcagtgaaagaaacagctggtcacaagtacattgtttgaaagagcaagatgaaatagaaattttttataagagatgcattcctgtaatgtagatggtgaatcaaagtctttagagtaagagttttattgcaataatttattataaacattatattataatgtctttagttcactactataatatccttggttctttgagaaatcctctccctcccactattcaataaaaatatctgatgcactttttcagggcttatgaaaacaataaatattgtgacaaatgactgttatcatgtctatggcgtctcatttgagtacagattcttttggcgcagaacaaacagggccaatgacttaacattaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaacgcaacacttgcaaatatttcgctagaaatttatacacacacatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagtatgtttttaatgtatattttcattaacatttcagattactcattcattcactaacatttttggtacatgtgccatgtacactattctagatatgtggggttttttagtggttaaaattgtcaggttagaagccagatattatttattaggaatttacttcagctctccattttgtaatttccttgtgtctgagaaattgtatctactttgtagggtttttgtgggtatcaaatacataaaaacatatgtaaagaataaaatgaagcctgagccatgttatggtatcaaatcctagatactattaattactgtattctcatttaatcctcacaataagcctgttgggtaattattattattctcattttgcaaggagccatgctatcctaaattatacgtctaagaaattccagaattcagatgaactcttagaatagtccgaatttcaaaatcatgttctttccattacattgatgacaggacatttcaggcaaaataaatattgtgagcataagcatattggtgttgaaatcagaatgtttcatggtggtctactgagaatttacccctcttgattttagagttgtgggtaggtaatgttgaatagttggatggccagtttaaagacaatctgaaaagacaggcattataataggaatttgctgaggttgacatttgaagacattgattatatttaggtatgtcttaagatggcaggaaaagataaatctgtttggaaggggacaagattagcaagacaagtgaggatgattttgtaggaatctaggtgtgaggtcacacagccagactaaaatggtgtcggttaataaaaccatgtccagaaaaccatagatatttataagaaacaaatgatacgttgatagactataataggtgaataaggggaaagagtaccttactttctgacttgagagattggcctccttcacctagtaaataaatcaaaatggaatacatgctatgtgtctgcccttgtgtttagcaccatgcagtaagtggtagaactagaacttgaactctggggtgttttgcatgaaggtccttactctcaatttcactatactgcctccaacctatgagtgccatttagctattttgattctcattctacagatgaggagaatagggctcaaagatgcctcaggttgtcttaacaacagagttatcagttgtaaaattcagaaccttcgaaatcttgttttgtacttcattattattgaattcttttatagttcttttagcataagtgtgagtctctatgaaaaattattttatttacttgaggttatgctgtgcctcatatgtttgatgacacattggttctatttgctctgtgtgtgcgcctgtgtgtatgttatatacctaggcttgagcagggcaggggaggcaaaatttcctcattgtccagagtggaacctctcagtctttcaaaggagactcctgcattgggcattggagatgtcttatgctttttgcctttgctacacacttctgatcccggagaaacgattttcattctccagcaatgatttaaaaaataatttatcacaaaaattaaatagattgcactgtaaaaatcatataattactcctgtaaaactacagatgaaagcatgcacagaaaattatagtggaaagtttttaattagcttctgattaactgtaagcttatgttttaaatgtaccatgcagaaccttataacaagtaggcataaattaaatagtcactaatatgtatgtagcaaaaatattaatacggctgctactagggattttcactggcatatttttaattttttttttttttactttaaagtggagtagattctgtagagttggggtatcaatcacatgatcattaaaagggcaaaatattttttcaaaacttgtgcaataatctttacctaactggctatgtggttggtgatttgttcctctcttaaagagcgaacaggcgctctttcaaatggagatgcttacatgatttcatgtatattcttagttttcatgggagacctatcccttcagtagaaggaaatgctagctttaggtcacagcaaaactaagctttatttttcccattttgtctagtctatgtttcacatgttaaagttgtgaattggacacttaatttgagtgagagtcagggtatttttcaaactatatttagtgactttaacttgctgagtgacctaggacaagtcatctaagctctctgggccttagtgttctaactggtaaaattagaaggttaaattaaatgatctttttacctagtgtcaaatcaaaagaatcacatttctatattaattgtatttttaaggttgttggtacctaggttcttttaataatatcttggaaataaaacattattatattctttaaaatgtacatataacaattgtacatatttatggtatgtaccatatttatggcaaaatgtgatgttttgataaatgtataaattttgtaatgatcaaatcagggtaattaacatagccatgactttaacatttatagtttctttatgatgagaatattaaaaaagtctcttctagctattttaaaatatggaatacattattgtattatatatcatagtagtcatcctgctgtgcaatagactaccagaccttatccctcctatcttactgtagatttgtactcgttgacaaatatctctacaagtgtttttcacaaagaagcccctcagtattctgacatgaggaaaagcaacgaacttgctttccatttatgcaaattagattgttaacttcctatgcaactaggaatacttaacagtacttaacaatatttatattgttcctttggacataagtatggctatgattgcccccacctcccaaaaaaacaacaaaaaggaatcataggaaacaatttttaaacttattttcaattttttttattattgattaaataaaagcacaacttaacaaaatataggcagtcttgtactttatatacaatgatccttctggggagacatggaaattcatctgtcttcctcaagccaagtgggactgttctgtcctaggagaagggatttttaaggagtggggaaggaaggggaaaaaaaggaaatcttttccttattgtcaccactgcttacccttttcaaagaagtatcttcggttcttagaaatcccatgcccagggtgaaaatggagagaaagaaaacacaggaagaagagagtatatatagagagggaggccagggaactaggagaacagaatgagaggcaaggtaatctctctcacccttttaggaaaggactctcattgcctgtgctccttctttacctgacaagctgcagttgcccctacctctactgttgcttttgttcctctgtaataaagaggtagagaagaagggaagaagaacagctgaaaagcagagaaaggaaagaagagttggcagtgaaaggcaaactcatagattgccttaaaacttccatggctgccacttctggccccctgtccccactgcttcatcaccatgggctgaagctagcatttaaagggggaggaaaagagagaggaatctgaagacaggaagctctagtctctttcagtatccactgtgttcttcatctacccaccccctcccctcatctgacaccttgcctaggacaagggctcttaacccctgagcttccaatagtccctaaataagctgtacaatgttttttactctgtgaaattgtaggtagagtttgggtgtctttggggcggggagggttcatagagtttctccgatttttagatacacccagcataacctaactcacctgtgctttttaatattcttctttggcttccataggctcttctgaaaacctaaccactatatgcacaaagttcttaccattggaaaacacctttaaatgatacacagagaaagtttccagaaaaatcatttcaaggttggagaaaacctattatacttttttaaataaaataggaaataataagctggattgaggtaatatatatttggctcctactcacacaaaaattttgaaaaagaaaaaaaatgtttaatttattttttaattattcatttgtaatcacgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccagggttaaaatatccttcttacagaacagtgatcctcataagtttaaacagactggaaacaataaagcctaaaaagaaaatcatgcacatcaacaattttctttctatctttcaactttaattttcacccttatagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaattttgtgccaatttcatgaatgaggaaactagatattgagcaaagtgcaaagatagacattacagtcctgacctctggtaagtatttcagaattgtcactttcaaaaggtaattcaagaacactgtatttatgtatctctcaataagttcactatttgcctctcctatagaaacatggtagttgttgtgtgaaccattatccaaagcaaagttagatcaatactactgaagtaaataaattgaaaactatattaaaactgaaaaatgtggttgtgaggacatgcaagaaaaacaatgtggtgctactagcctggaattggtatgaataagccctttaaaaaagaaaaaatgaatccttaatctttatgccttagtatcttacaattctccattaacctttgataaaaccatcatattgggcacaaaagaaacacagtcaatgaatttttcttgatattcttttttacaggaaaaaaatcaaacaatgtgattcattataaaacctatggtcagaatcaataatctatgccttcatatcatgcctgtttagataataattattaagccaccatttaaaattttttaaactcaaattccatctgcaaaaaatctattttgcttttaaaacttaatattaggtttcaactttactttctgtcatccttcttttggttgccacatcagtagactcagaataaaagcatctgcccaaagcaaatacactggagttcactgtcaaacagagattcccaagaaaccaaacagaaaaggaataaaaatgagaagcatgttttattaaatgtcttctacacctgcttcctttatcttttagacctgcttaccaaagcccattggatattttgattttttaagtcacaggcatatgaactagcttgaacatttatagtatcaaattattaaaggtaatgacctggtatttaaaaaatgatgttccacatctaggggatctccatgaaagcttttcagctgaataaaggttataattgttaaacaaattggttatttattaagctagcactataaacaaaaagagtatttaaacagctggtatccctgtgaccctacctttaatcttctccagagaaaatgtgacaagaagtgatatttaacaataattttagaaaatgtaatgaacaccaattgattatgtaacttgcattttattttcaaaattacattaaaatagtatgcaactattcatttaaatgcattttagaattaaaatgaattattttcacctacaaaacttatgtttaaaaatgagatagtactgttttattattgatctacattaaattagcaatatgttaaaattcatttctatattgtaatgcttggaaaattataaatttttgaactttttaaagctatgcttgaaagttcaagagagccttactcagtaatgaaagttaaacaaacaaattaataatacataaacaaaaaggttgtttataaccagtcctgcacaattttaaatctatgcagtagagcaatgtatgataattttaataaacacacaatatatcaacacattttcatggacactatatttttaaatagaaatttaattttggaatatttttaaatgtatagaaaagttgtaaaactagtacagagtttccttatactttatacccactttcttctatattaatatcatatttatagtacatttatcacaattgagataatattgatatattattatcaactaaaattcatattttattcagttttcttttttagtttttacctaatgtcctttttctgtgacatttacataccactttatgtttagtcatcgtgtctctaagttcttggctgtcacagttgttgaaactttacatttttaaaaataattttgacagttttgaggggtattggtcaggtatttactagaatgtctttttatttgaaattgtctgacatttttcttatgataatattgggataacagtcattgggttttgggaggaaaacaacagaggcaaaatggcattctcatcacattaaatcaagggtacttactgttaacatgatttactactgtccttgatcccctggctaagttggtgttgccgtatttctccactatgaagttacgcttcttcccttttttcattttgtggtctttagaaggaagtcactatgcaaagctcacacctcatgttccagaagctgcttttccaaggagtgaatatttatcctccacccttttgagtgtggagcatttacttaaattgtttggatttatgctctgcatgagagacttatctattatcttccattttaaaatgtatttaatcatcctatcagtatggactcatgaatatggatattattttatactatgaattatagtccattactactctattttgttgctcaaatagtttcagacattatcttttgaactacttatggttggaagttcctagcacaatgccagaaacatagtagacgttaatggtaatttagtgtgaacctaaacttaaaaatatgctcatgggccattttttaatttaaaaatagaaagtatattctattaagaggtactcgatccctaattgcaaatccccacttatatccttcgaaacaaaaaaaaaaaaaagaggagacatggtatataatttagatattgccacagtaatgtggcattgtatacaaccatgaaactcagcagcagacaacaatgaaaatgtatttagctcatgaatctatcagggtaagctgatctgggttaagtttggctgacttgggcagggctcactcatatgtgtatatggcagaggtggagtggtcacagggggagtcatctggagctagtaatgcctcagatgacataagtggagcaactcagctctggtccatggttgcctctcatcatgaagcaggacagcctgagcttgttgtcatagcgatgagcaaaggcaagtaagcaaaatgtgtaagtgctttctgcttgtatcccatttgctatccttacagtggccaaaggacagcataaggtgagcccaagttcaagaagtggggaaatagactgtaactccgtggtgccagaaactgcaaagtcacatggcaaatatagtgtctacaggaaagggtaaagaatagagaccattaaaccaatcaatctaccatgcattaactatacaaaggaacgagtctaagctctcatgggtgtgtgtttattatttttgaaatcagttttcaccctgtttttgttatgaattatgacagtgagtggaagtgcagcattatcattaactatgtcatatttcagaagccgttcttcccaaactgaggaccaaatcatttaaaagtatgatagtaatttacttttcaattctgcactcattttagattataatgaaatcttactgaacaaatgctttttaacagagtatgtttccaatatgaatgaagatttcatgcagcaaaacttgagctgtaataatgaacaggtctgaaaaaacgaaagaataagctaagcctataaatctcttccatatacatttatgacagaattagacatatgaatactctattcttagagaatattcagtaaagcataaactcttacttataatgaggtctccatggaaatgctctttcaaatagagttattgacaattgcaaaatatacaacttgcaaatttttcgttttagggtttgtttaaattaagctttaagaattcatgcatatcaaatcctatttttttctgtagaaaaattcaaataaaatcatctgaaataagtcccctttttcttaaaacatttgaaaataatgtatgaaatgtaattaaacataaacttcaatgttcatatctcaagttctaaatacaatcctggaagaagcagtttctattacacttcccatagaaaactgcttatgtttgaggtagcattttgttttgaaaaagatgtgagcttcagatcctccaggaagctctaggtagatattccgattttctcttttgtaaaattggtttaaaaggtttttgtttttttaatctctctgatcctcggtttcctcatctgtaaaaaggaagtaatctgcctgcctcatatgggttttaatgagaattaagtgttacataaaatgtcaaacttagcacagcgcttcacacataacaaactccttactaactccttactcctgccttccaagatgtacacttttacatttacttacttagtactccactccaatagttttcttttgcataatagaatgcaaaatgcatactagaaaggaaattgtcctgcagagtttcagcaaaacaaatgactggcacaaaccagtatgttattacaaggatttatatacactcttgttctaatcatattctgtgaaacgtaacaggagcatatattaaccagcttcatataaccaattttccaaactaatatcaacactaaaaagattttcaggtatattaagctggagaactttgttcagaagactttaagaagtggccatataggaaagcaatcaggattgcaaacattaaactttagcataaataccacttgttcctcctttcagagacaatgaaaactcttgcttatggctataataatcaggctacaaggatttctaagaactgttcttagtttaatttttctgctattgccagatgcttttcaccattctaggtgcccaaatcctgaagccaaatttaataaaggagaaacaggcctaattgataaatggatgttcagtatgcgttttccagtcagaacttgccttggcttagtggaacattctggtagttcaggcaaaaagtgtttcactacaagatcctgaacactatattgcatagaatatttgaaaaccagtgatgtccaagtcactaaattcttcctttacttctttcggatgggactaaagagaaggagtagcttgaccttgcttctatcaccttaagaaatatatgcacactctcaaacaagctgatacactgaacactggattatagacagtgcatttaaattttgtaatggatatctgatgaactagtcagagggattgaatctaccaattaaagtctgtcccactgcaaaaatagtcctcctgggtctgttgccaggaagaagactgagtaattaagatcaatgcagtttttttttgtattctgatgtccatcccccaaaacatcacttatttcattgtcccaccaagggggatataggaaagggctttctatcaccttaagaaatatatgcacactctcagacaagctgatatactgaacactggattatagacagtgcatttaaattttgtaatggatatctgatgaactagtcagagggattgaatctaccaattaaagtctatcccactgcaaaaacagtcctcctgggtctgttgccaggaagaaaactgagtaattaagatcaatgcagttgtttttttgtattctgatgtccatcccccaaaacatcacttatttcattgtcccactaagggggatataggaaagggcttaattataagactggtcagaaaatataagacaaaggtatccttgacattaagaatttcatgattcataacaactttaaaatattgtctattctccatatgaagtgactttcccttttaaattatttggtatttatggaactaataatgtgttgtgctaacacagagcttttcatccaagaacttcaaagcactctttatttgtcacattctgtgatcatttagtttgactataaaatattttatgattaatattggagcgagaaaacatgcaggaaaacaaagtataatattgggggaaatttcaaatacataagatttcatcctgactaattatctcagttttctgtagcccatggtaaattaggatgaaatatgcttgcacttaaaacttagctttgctaacatctgtttcttttaaattagattttaatttaaaatggcttgtccttacttcaaaaatatgagattatttttcctccgattttgagtttttcactaaaaatcttatatattaatatatataaatgtattctacattggcctttttatcctcttgggcaattactaaagtaattcatagacctgttcttactggtaagtagggataaattaaattgtcaggacactaaagtaacattagataaattatgtttcactgacttaaagacagttaattctctagaaatgaagcagtttatttcttaactcatgggtaagtttatattggaattttgaaggtgctcgtgaaatcattgtttaaatgaggtcttatttagttgagcacctaatgaaatttcttgccatttctcccagtgattatacatgtatatgtaaactgtcaaccagtttcttcatgtgaaacgcatcctaaacttaatattttaaaatccttatatatgtgatttaagagcaagcctctggagagaaactgttgtatgaaaataagtaaaatcattgtttggcttgctatattatagtctttgcctatgctactaatcaatgatatggcatcaggcaattccttaactttcttcaactgtaaaacaagggcatacaggttaatgactcctcaggtcattttaggcttctatatgatttaatacatgatcactttctaaaatatgtatttttttatctgtttctaaaccatgcttatggttgtttactactgacaaaaatataagattaattataactgatgtcatacctatagtcagcagtgctgaagcaaccagtgacaagtcatacaacaaaaaacgtgtctcctagagctgttaacagtaaaataaaatccactcttactgcttctgaatttaaatccgagtactttcctgagtaaataaaaggaggacacaaaccctgctggacgtttctgagagcacattatgactgtcactattttctttccattgctatcatatgactcaatgtcagcacagtgctattcatttttactctttatagggccataagtaattgataaaatggtattggaagattcatttgttataattcttttagtagcaagtaataagatgctatctcaaactagattacataaaaatgaaatttattgggtcacataaaacttagaaataatggggtaggactggctgcaggcctagaatccagagcctatatgatgccaaaatgcacatcttaccattgcttcacttgtgtattagtccatttttatgctgttgataaagacatacccaaacctgggaagaaaaagaggtttttttttgtttgtttgtttgtttttttttgagacggagtctcgctctgtcgcccaggctggagtgcagtggcgcgatctcggctcactgcaagctccgcctcccgggttcacgccattctcctgcctcagcctcccgaaaaagaggtttaatggacttaacagttctacatagctgggcaagtctcacaatcatggtggaaggcaagaaggagcaagtcacatcttacatggatggcggcaggcaaagagagagcttgtgctgagaaactcccgtttttaaaaccatcagatctcatgagacccattcactgtcacaagaaccagcacaggaaagacctgcccccatgattcaatcatctcccaccaggtccttcccacaacacatgggaattatggaagctacaagatgagatttggatggggacacagagccaaaccatattagtttggttttcccttgtcttgacttcatttggacaacttgttgccagtgtattttaggatggcagggattaaaatccatccattcaacaacttcagtgtaaacagtttattttattttatttatttatttatttttgagacggagtctcactgtgtcgcccaggctggagtgcagtggtgcgatcttggctcaccacaagctctgccattctcctgcctcagcctcccgagtagctgggactataggtgcctgccaccacacccggctaattttttgtatttttagtagagatggggtttcaccgtattagccaggatggtcttgatctcctgacctcgtgatctacccgcctcagcctcccaaagtgctgggattacaggcatgagcctgtatttaatttttttaaattaatagttctagcaaaagttcttcaactgagtcttcttagtttagtgtagctcacatgtccatctaaatcaatcttatgattcaataagatggactctttcttctggccaaattaagcatgtgcacatctcttgagctggtcagggttggagtggggaatgaagtcaactttcctgaactgcataaactgagtactggggaggagtgatgatgcaatgacagtcagggtgctattcccagaagggtgaatgactgctaggttatcacaagcaatagatatccactacaaacaaaagtcaaagaggaagaaaaagagagtcagaaagggaaggaccattctttcaacaactgtatttgaagtgttaccatgtgtcctgtacactgagaatacagatgtgaacaaaacagacaaaaaattcttgtgtccttatgtaactcttaatctggtgggagagacagtgtatatgttgacctctggcaaaaatattggtgtaaaacacttcatcatgtgggaattatttggattcaaatattaggtctaagactggatttgcttggttaatttctcactttcatcctctgtaattttgaggagctcaaagttgctaaagtttttttattttacttacaactgattgttgcctataacagaaatatctaaaaatgtaattatatatttttaaaccgatatcatctattataagtaattatttgctttgattatttttcctataccttttggagaaatctttagctgtttttttataagcctttcccaatttctgaaatactatatgtttctatgacaataataggacttcatggcaaaaatgagactaaaacattaggacatttcatccacaataattaataaggaagacaagctgaatgcataaagatattctgattaattcaactatattacatgaaccctttggtacatagatggtagggaaatccaattagctataatatttaagagactgctgtcctaatacatatatcatctttctaggataatagcttcttcctctgattgtacattttttttcctccaaaggaagaaaaagaaaataatctaacgtggaaaatttttcttttgaaatctaccccaaaatttattacaatagtgtaaaactccttttaaaattttaaatgtattcaaaataccatacttaaactattctatacaaattagaagcaatttattttatagctataaataagaagagattcctaaactctcatattttatagtaggaaaatgtatatttttatcaatcttaaatttaggccacatttatattttaaaggaaatggtgtagcctaaactcaaagtttatttgtaaataaataagtctctaaacaatcactcctatgatgtaaaataaacttgaaagcaagaattttccctctgctgcccactaatagcctttgctttctaaacctttagtcatatctgtcatgtcctttaaaaagaatgtgatcttccttaaagtatgagcttgatagtccaattattgatcttctgctactgggtatgatggagaatccttaatttttcacagactatatactgatctagtatatagtctacactatatgtttgtactatattatacaactttatactatacttaacatgtttgctttttacataattcccccatattgctgacataatctattattcataattcggactccttggcattttacttacttatctttatacataagggacacacataattttatttttaaaatgttagttaagcttttaaaaagtctcagaaaaacatgaaaaatctctataattcaataatgtatttattcagtatctactagggaggatttaatcgataaatgttaaaagaaaatgtttcaccatagaatagataccaaaattatatgataatgaattatctaattattatgcaaacattttattaggtatataggttttattattttcttgtaattctcaatacttgaattttacaagtgtcactggcaaatgttgactaatgacaaaaatgtcaaatacttgtctctgtgatgaagcaatcatgttgctacagatattgtatagagacacagcccagatgtggtggctcacacctgtaatccctgcactttgggaagctgaggatctcttgagcccaggagtttgagactgcagtgagttaggattgtgcactgcactctaccctgggccacagagtgagatcttgtttaaaataaataaatgaaggaaggaaggaaggaggaagcaaggagggagagagggaaggaagaaagaagggaggaaggaagaagcagaaataatgttataatactacagacgaaggtatatgaaatcaggatggtaatgacagttgcaaaataggtgaaagcatttgctcttcctgccagagcaagatggctggggggccttagacagtgagtaatcaaaattggaagcagaaactatggcttcctagttgctagtagctagggtaatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtggtgatgacacagagtggactagaatcccagagcagtcattatttgaatggtttgtgcaattgacatatgcctcagtttttgtttttgttttttaaccaataagcatggaaaaaaaaaacctcctatgttagtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatgaattcaatctcaaggcagagggagttaacttctgtggcctatttatatttctgaaggagtcttccaggctgaaggtcagggcaaaaagtatagtcatttcttggagtgcaaaatccctgtgatgcagacactgttctatttgttgttgtcattgttgttactgttgttgatatttggctataacataagaggaaaagtgtgcttatagagatattttcttttctattctgtgaatatcataaaaagtaaggttagtaaatgttataaatgaattctgtcagaaaacactttataaaaggaaaaatctcacacgccatccattcaacaatatttaaagcccacttagtatttacaaggaactctactaatcaatgaaaattaacgtgatcaggctaaagcttttgaggggaccaggaaaaaaccaagtcataactagagaaagcaccttggggaagtttggctatagaaatacaaaggcatagcatctaagtcaaatgaggcgaaaggaagtcaagagaacatgaaccaggaagggaactctcctcctaggaggtggcacttgagaagagataacaaagaaagcattggttgcacaattctaatgtcaataagcaaaatattcattgattatctactgcccgtcttagaatagcacaaagggccttttcaggcttgtcttattttgcttaaattttgaggttgtgatgaagttgaagaagggaggatggacttggagaaaaacctccaagttataacttctcaaaggcagtaattagagagtatctcctctttgtctctgattcaggactcagctaaggcccagcaaatgggaaacttcctttttaaaaaaagccagtgtagtgctggcagtcattaaagatttgctgaattactgacctcttatcgcccacatgccctggggaatctgttagcagtccaccacctcttgtcactaatcaagatgcctttatgttaacacctcccttttaaaagcaaatcagtcaggaaacttaagtagattaacacttaatcattaattacctcatgggataaccaaacaaatttcttttctgtttaggctatctctgatcttctgccccaggatatatttttcaggcattgaaggactgatgtgagttactctggtagtcctggcacttagggtcttggtgaatctgcttggggaaaggaatgaaggcatggaaacaggacagaaaggtgaagctagagcagagaaaaagcactgaaaagaaacttcaactgatttttagtttcacctagggtatttctaggagttagaacctccatccaagaatgcctgagctaatgtaaattaagatctgactttatgtcttggttctacccatcaatcataatcactcggttattaacagagtatttgccaaaggccaatggcacttcgtgaccaaacaagaagaaaaggaaatatgaaagttcttaatatataacttttcttgtgggtttacattttctttttttttttagttctgaatcaggtaattgattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtgtgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaaatatctaagtggatgctgcattttttcaaagagttaccctgagtggcaatatattcattccaagagtgttgcctttgcacatagatcattgcagctatccctttcaaatagcatttagaatctattttcagatttaaaaaatagtctaacattagttttaaaaaataaccaaaggtatttaatgcacaccactacatattatttctttctatatacatttgtgaatttattgggaagagtaaacagttggagatgtgtcaatgctgggtttgaggttggatgagattttatattattaagtggagattattacattagaatgagactagaaccaatctatcttgggcctttatacttcttttttctccctcaggtttgaggtatcaggacacatttagggccctgttaccttttaaacataatatgggctcaagtaaaatgaactattattttcaaaatatattaacgcattacaggatgttagccaagtaaatttttatacatatttattttactttaagtgaatatttaaaatacattttcagtttgtttcttaggataagtgagaaaaatatcaaatatttgagagaaaaaaagatttttaaaaagagcgagagttactcataaaaaatgagtaaattcggccaggcgcggtggctcacgcctgtaatcccagcactgtgggaggctgaggcgggtggatcacgaggtcaggagatcgataccatcctggctaacatggtgaaaccccatctctactaaaaacacaaaaaattaggcgggcgtggtggcgggcacctgtagtcccagctactcgggaggctgaggcaggagaatgatgtgaacccgggaggcggagcttgcagtgagccgagatcgcaccactgcactccagtttgggtgacagagcgagattccgtctcaaaaaaaaaaagaaagaaagaaattacatttaataaaactgattccttcaactttaaatacatatactttttaagataaggtctccttctgttgcgcatggtgaagtatagtgagtatagctcactgcagccttgaactcctgggctaaagggatcctcccacttgagccccctgagtagcttggactacaggtcaccatgcctggctaatttaattttttgtgtatagagatggggatcttgctatattgtccaggctagtctcaaactgctaccctcaaatgatccacctatcttggcctcccaaagcctggggattacagccataagctacctcgcccagccaagattttgtttctattttgggtgcaccctttataagagatcaagtacaccattaacatgttatgtgtattacttggaaaatgaaatggaaacattatccattcaatcactaattctctcaagaagacatgcctatattcccaggggctaaattatatattttttctaactgcattcctaactccccagctttctccagatcctgatatgtctcctccctgttctattcatttccattgtgttgaaaaccatactctgcaaggcgcagtgtgtctgactgaagtatattatgcacgcgagctttccaaaagctgaaaaaaatattgagaaccaatgaataaaaccataggtatctaaaagacattgaataataataagagatatacaatagaatttaagaattcattaataaaaagtataactggagtttttctaaaataatggactcttaaaccagtaaaatatatatctaatttaaaatggtttcttttaaattataataaaacatatacatgtaggcacatcttattaaacaatggacaaatgtagaactaaatttcatttccacttaaaaaggcacaggcaggtttcaaatggttctgcatataaacttgctgacatgaataattttaaatcaggccagttatagctttcattctttgaactgaattcaaaactctcttacttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacagtataagtgctgaacttgtgttatacctttcaaataacagtaaccacctctaatttcttaaagggctctttaaaaaaatgcatggtatgtccatcatagagcaagaaatgcctctttttataatatattcaaaatggaggtggttatgtttccttttacactggtattgcaattcattttctgttagtaagcaagaatattgaccaactgtattacactctgttctcacactgctataaagaaatacccaagactgggtaatttatcaagggaagagatttaatggactcacagttccacatggctggggaggcctcaggaaacttacaaccatggtggaaagggaagacgcacatcttacatggtggcaggagagagataacaagcaagagcaaggaaaactgccttataaaaccaccagatgtcatgacaactctctcattatcacaagaacagcatgggagaaaccacccccatgatacaatcactgcccacttggtccctccctctacacatggggattatggggattacaatttgcagtgagatttggttggggacacagagccaaaccatatcaccaacataatataaaatcactttgaaaggacctcaaaatacatcctaaaatttgtttcaaagatgaaaaatataacttaaaataccatgacttctgaatcagggtagtttgcaaggtgattatcttcacaattagaaccaaaatgcttaataatactattttagtttgtgtaaaactttaaagagtattcatgctcttcatctccctatttctatcttttttaaagaaaagcagtcaattagttaaataatcactaatgcagttttatatgataataaataatgacaccaacttggattgtcttaacaaatctgaacagtgacttttcttttgagaattgaaagcatccctagaaacaaatttgcctgtatgtttaatgactcatacattccaaatacatccaggagacaatcaacagtttatctgatgtatgatatataaaacaaattatttaagtgaacttcatttatcttagtctatacgatataatcataatgctatttataatgagctcaaatagcaacaagaaaatattggagaagttaatattgaagaaataaaattaatcaagctgtcctactattcaatttctgaatattcagatacagtaaatgttagttaatacatgaacaagtaattatcaagaaaataatccgatttacaataactaacaaaaaaatcttatggatgagtttaaccaaggaggtgaaagattactacactgagagatcaatacactaaaacactgaaaaacattgataaaaaaactgaagaagacacaaataaatggaaagatattttgtgctcatgaattagaacccttaatattgttaaaatgtccatactattcaaaacaatctacagattccattcaatccctatcaaaatatcaatgaaattcttcacagaaatagaaaaaaatactctaaaattcatatggaaccacaaaacaccccaaatagcaaagcaatcttgagcaaaaagaacagatctggaggcatcacaccacctgatttcaaaatacactacaaagctaatagtaactaaaacagcatggtactggcattaaaacagacacacaggccaacagaacagaatagagaagatataaataaattcatgcacttatagccaacttattttcaacaaaggtgccaagtatacacgtgaagaaaggacagtctttcaataattggtgctgggaaaactagatagtcacctgcagaagaatgaagctagacctctatctctcaccatgtacaaaatcaattcaaaattgattaaaggctgaaatgtaagatctgaaatgataaaactactggaaggaaacctaggagaaatgcttcatgacattggtctgggcaaggatttttttggataagaccacaaaagcacaagcaagaagagcaaaaatagcaaaatggaattacatctaatgtaaatgctcctgtacaccaaaggaaacactctaaagagtgaaaatagaacttacagaatgggagaaaatatttgaaaactatgcatctgacaagaggtaatatacagaatatatcaggaactcaactcaatagcaaaaacccaattaatccaatttaaaaatatgcaaaacacctgagtagatatttctcaaaagaagataaacaaatggcaatgggtatatgaaaaaatgctcattatcactaataatcagggaaaagcaaatcaaaaccacaatgagatatcacctcactctgattagaatgactgttatcacaaagacaaaaaataacaaatgctggcagatgtggggaaagggaattcttatacactggtggaaatgtaattagtattagctattatggaaaacagtatgtaggttcctcaaaaaattaaaaatggaacaaccataaaatccagcagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtacacacacacacacacacacacacacacacacacacacacataatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatctcatagaactaaagagcagaatagtggctcccagatctggaacgtgtacaagaggaaggatggggagaaactgagtcagcaggtacaaagtcacagttagataggaagaataggttctggtgttctattgcacagtagaatgacaatggttaacagtattgtatattttaaatagctggaaaagaggattttgaatgttctcgccacaaaaaaaaatgataaatgtgcgaagttatggatatgctaaatgccctgatctgattttcgcacaatgtatacatgtatcacaacatcacactatataccccataaatatatttattattatgtgtctcttaaaaacaaaatttcaaaaatggtaatcttgttatactaaggtttctgaaaatgcaaagagaaatgtgatatatatatgttactcctttaaacttaaagagtaaaaaattaaaatcaatgtatcctaaatactaaaaaaaaattagaatgttgagctaagacgacaagatgaaaaagagtagtacttttagtgcaggagtaaatttcagaattttagagattgtatttttaaaggtaaatcactacctgtcctgttaagaggaagctaagacagatactgtggttctcacctgtaatctcagcactttgagaggccaaggcaagtggatggcttgagcccaggagcttgagaccagcctaggcaacatagggacatgccatctctaccaagaaatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttttgttatcaaataatgctggcagtggaatgaggctcacgacattattatcaataaacacataaagaaaataaaaggctatacctatttttctttctaatgttctcaagagtaggccaaaaatataacaagcaagatactagaggtttagttaatctgattgtattgttttcatatagatctctagatttctgcaattggatgtgtttaacatgaaaccttgatatatgatttcactaccaacaacaacaaaaaatcagttgggattatgatttctaatggtgtggaaaccctgttttataaaaataagacacattagctacttaaagttcatctgaacctgaactgtaattatttcagagaagtcctgaaatcattttggtcctgatttagaggtcttctttgtcttttcaatttaaagcaattttcatgtatagatttttaccacatttccaccttttataaaaccctaaagaatatcagtcactaaacctactgtagtaactgatctgatattcatttaagctaaaactttaagctaaaagaaaataattaaatttgtttgacctaaaaagaatgtccttgcattttgtagtctccattaaaaaaaaaaacactccagtaatctttcgaatcttttttcagccaacagctctgtaacatcttgcctctatacatgatactgcctttttagccaattccaacctagagcaatgagtaaccatggctccatccaattttccacatgacatctgtggcagtagaagtattaacaggacttctctcctggagagctttgccttaggaagagcttaaatttctgtaagaaagtcactgacacaggaattcagtcaggactctgcactaggactagaagctgccagggttcagatgctgacaaggcaatgtttcttatctctgagatttcgtgcccttcccccatgaagctatgctcctccagtctggcagggaactcgcctatggacaagagggtgacagacatcttttgatgatgagcatccacaggcacagggaacagaatcttgctattcattgagctgcacagctgtggcaactggattctgcccgggtgtcaacaatgggggcagggcttcagtttaggcaaaagggaaacagcttgagtataaatgaactgcttttaggctctttgaatttatcttccccagatgccctgagatttcagatccactctttattttactaaaacttcatagctgtgaagtgaccatcttctctgaaggctcacatggaaaaaaaacaaacatgtttctacatggtaaaaggcatgtttgcatatttacatatgaatatattgatggatccttggcattaatgattctacaactgtatgttcttattaaactctgggttcagcataaaatagtatcttactgatttatcttcagtgctattgtatggtctgcttggctgcaggttgtataagatgacaaagcattgatttagtgaattttttcacagttttgtgaacaaaaagcttgcatatttaataagtaagttattcaaatcttgaagaaatacaggcacgttctccaggcatttttagaaagaagagaaagagaatctatagcaggtggatatttccaactaggcaaaacgaaaagcacacaaagagttaactcaactgtataaatgaatatgctaatgaatgcataatttatctctgaagaaacatatttattgtttcactatttgattagatggcttcaatgttcaattaatcagttacctttcaatatcattcctgagagctgcttaattaatctgttgcactaccaccctattcatcctattagcaatccctcgtcccatttcaaatgacaaaatccaggaactgtgccacgtaaagactttatgtcaatgtcaagtgaaggttgataagtggctggctttttttctttattaggttaatcaaaccaatcagctttataggatttacatttgtcagaaaatgttaatgagttgaaactaatgagaaatagagggggaaaaccaccaagagaatggtggcacagtttatacacttcaacagcaatatactactttcattaaatagattgttttatcctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccttttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaatggacaaaagtagtatgtaaatttagaagggtgggagatcagatttaaggcatcctgaggtcaaggtatatttggagaaaaaaaatactatttaaacttcgttcagaagaatgacgtagagttttaattaatcaattccaaacatgtagagggagaattaggatggggaagagaaaaagtacacccaaaggaggtaggaagggtgagtgtaaaacaggaaaggcagaatgaatagaaaggataaatagaaataagagagtggaaataaatccaaagaagtaagtaaacaaaataaaggaaaaaaaaatctgagcatggtggtgcaaccctgtaatttcagctacttggaaggctaaggtgggaggattgctgtagctaaggagttcaagaccagcctggacaatatatcaagaccccatcttgaaagaaaaataaagcaaggaagcaagaagaaaggaaggaaaggaaggaaagaaggaaaggaaggaaatgaaggaagggagagagggaggaaaggagggagggataaagatgaagagataagaaaaaaagaaaagaaagcaagaaagagaaagaaggaaaatggaataagctgtcctgttaaagcacaaagaccctcagaccgcatagaaacaaactccagctatgtcatttctacaagagactaattaaataaaacacaagaacatgaaaagtttgaatgtcaagcctagaaagaatatgtcaggaaaatattaacaaaaagaaagcaggtctacaaaacaaaacagactttgagggaaaataaaagcattaaaaaagataaagagagtcaataaataatgctaagaggttcaatttgttaggaacataacaattgaaaactttatttactgaatagtacagcttcaaaatatataaacaaaactggtttgatctatgaagaggcattaataaatccttcactattttaatacagctttcttggttattggcagatcaagtataaaaccatattggcaaggataattgagatttgaacagcataatttaaaagcttttaggacactgcgttggtttgccaccttccccaagtcccaaattcaccccatatacactcccatcactcttgtcctgactttttcattggcttatctcagggtagtccttgatttgggtctgcactgcaagttgtattatctgcctctggtttgtggctttactcatattctcaattttaccttcacagtttcttaagcaagatttctcccttccagtatcttagtgaaataattttttttcattttttggtttttttttcttccaaaaaaaaggatacatgtgcagaatgtgcaggtttgttacataggtatacatgtgccatggtggtttgctgcacttattgacccatcctctaagttcctcccctcactcccacctcccaacaggccctagtatgtgtttttcccctctctgtgtccatgtgttctcattgttcaactcccacttatgagtgagagtcgaacatgcagtatttggttttctgttcctgtgttactttcctgaggatgatggcttccagcttcatccatgtccctgcaaaggacataatctcattcctttttatggctggatagtcttccatgatgtatatgtgccatattttcattatccagtctatctattgatgggcatttgtgttggttttgtgtctttatgattgtaaatagcgctgcagtaaacatacttgtgcatgtgtctttataagagaatgatttatattcctttgggtatatacccagtaatgggattgctgggtcaaatgaaatttctggttctagatccttgaggaattgccatactgtcttccacaatggctgaactagtttacattcccaccaacagtataaaagcattcctgtttctccacagcctcaccaatatccactgtttcctgactttaataattgccattctgactggtgtaagatggtatctcactgtggttttgatttgcatttctctaatgacaagtgatgatgagctttttttcatatgtttgttggctgcataaatgtcttcttttgagaagtgtctgttcataccctttgcccgctttttgatggggttgtttgttttttcttgtaaatttgtttaagttccttgcagattctggatattagacctttgtcaggtgggtagatttcaaaaatgttctcccattctgtaggttgcctgttcactctgatgatagtttcttttgctgtgcagaagctctttagtttaattagatcccatttgtcaattttggcttttgttgcaattacttttagcatttttgtcatgaagtctttgcctatgcctacatcctgaatggtattgcctaggttttcttccagggttattataattttgggttttacatttaagtctttaatccatcttgagttgatttctgtataaggtataaggaagggttccagtttcagttttctgcatatggctagccggttttcccagcaccgtttatccaataggagatcctttccccattgcttgtttttgtcaggcttgttgaagattagatggttgtagatgtgtggtgttatttctaaggtctccattctgctgcattggtcccaatgtctgtggtgttaccagtaccatcctgttttggttactggagccttgtagtatagtttgaagtcaggtagagtgatgcctccagctttgttctttttgtttaggattgtcttggctatatggggtcttttttgattccatatgaaatttaaaatagttttttctaattctgtgaagaatgtcaatggtagtttgatgggaatagcactgaatctataaattactttgggcagtggccattttcatgatactgattcttcctatccatgaggatggaatgattttctgtttgtttgcatcctctcttatttccttgagcagtggtttgtagttctccttgaagagatccttcacatcccatgttagctgtattcctaggtattttgttctctttgtagagattgtgaatgggagttcattcatgatttggctctccgctcgtctcttgttggtgtaaatgaatccttatgatttttgcacagtgattttgtatcttgagagatacacaaactaaaattgtgtcctcaggatacagcttcaaattctatatgtttattattttattcaattttgtgttcaaatcatcctatgtgctatcatttttccaattacacagatgagaaaattgaggccctgggagattaaattacttgctcaagagagcacacctattctattaaaagggagataaaataatatttataatttttaaaaatataattctgaaaactctagcagctttttgacaagtgttttgcttttgttgtcaattaatactgttaccaaatgatactcttcttaatttattcatatccacagtgacgaattgcacaaaattatccaaaagattattaggtaggtctcatttagtggcaaccaagagtaaacaaactattttaagcaaaaagataatttcttggcatgaagtactaggaagtacaagtgtacagatggccttagacatggctggatctgggtactgaatatgtaatcagaatattatctctccccatctccccgcatgctttcctctatattaacttcatttttagacaggggagactgagtagatcacagttttaggaagttgaccctgagtcggtctgcctgtgtgttccagtcctatctaattagaaacagaggttacaaataagttcttcaacattgtttatttctcaatagcacctagaacagtattggcacatagtagatgctcattaattttttttttttttttttttttttttttttttttgagatggagtctcgctctgtccccaggctggagtgcagtggcgcgatctccgatcactgcaacctctaccttccggtttcaagtgattgtcgtgcctcagcctcccaagtagctgggactacaagcaccacaccacagcgcccagctgatttgtgtgtgtgtgtgtatttttagtagagacggagtttcaccaggttgaccaggctggtctcaaactcttgacctcaagtgatatgctggcctcggcctcccaaagtgctgggattacaggcgtgagccactgcacccggcctaaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataagaaaacatttggccgggcacggtggctcaagtctgtaatcccagctctttgggaggccgaggcgggcggatcacgaggtcaagagatccagaccatcctggctaacacggtgaaaccccgtctctactaaaaatacaaaaaaattagccgggcgtggtggcgggcgcctgtggtcccagctactcaggaggctgaggcaggagaatggtgtgaacccgggaggcggagcttgcagtgagccgagaatgcgccactgcactccagcctgggcgacagagtgcgacaccgtctcaaaaaaaaaaaaaaaaagagaaaagaaaacttttattagagataataagttcaaaatataaacaggtaaggtagaaatggtacacacgaataacaaacataaaagtacagatggaactgtgttaggaggcaggactcaactctggaggtggagctcagataccagacaaaattgaggactaagacaaggactgggcggaagtagctttcctgaagacatgctcactagtgtgccatgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagcactttggaaggccaaggcaggcagatcacttgaggccaggagttggagaacaggctggcaaacatggggaaacccatctctactaaaaacacaaaattagccagcccaggcctgtaatcccagctactcgggaggctgaagcatgagaatcgctcgagcctgggaggcgaaggttgcagtgagccgagatcgcgccaatggactctagcctgggcgacagagagaactccatctgaaacaaaacaaaacaaaacaaaacaaacaaacaaaaaagtaggtgtaaatgtgattgcagacctgccctgaactgctactctcagcacactgcctatggggtagccctgctctctgcaggagcagtcacaagagttgtaacactgccagagctgttaacactgctgcctcgatacaactgttttcttctaccctaccaccagcttgtccttgaattctctgctggacaaagccaagaacagttgcggactaagctccactgtcctgcatcagaatggcttcaaaagttacaaattgtcaatgacaaaatgtaaattgacactaataagttaatcacaaaattgagcccttaaaaatgatttcaatgttatattaggaacaaagcttcctttcctgctgtttttctatgtattcccagaaaaaaattcatagtttgtgtgataattctttattcaagcttgactaaaacttataagcaactacatagagttaccttggactcctctttatcgtttaacatgtggatgtaacattcaacccaaactcattcaagtacagaagggtgatgttttcttaatattagtacagtagagttcatagatagatgtttttggctatgttataagcccaaaatggcatgattaaagccattttacatttctctgcatgctggagtattttgtaaaatggctgtttctaagacaaatgcataagagcttctgcgtataatgaagccatagtcttcaggtaaaaaagaaaaaaaaaccctctagttaggcaagttttctctttatctgaaggtttgtaagttcaaaattaaccatttaaaaatgatcagaagattttaaattaatgtacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttttttctgtgtcagtttgccaagaataatggcctccagctccattcctgtccctgcaaaggatatgatcttgttcttttctgtggctgcatggtattccatggtgtatatgtactacattttctttatccagtctgtcattgatgagcatttaaccaaatactgcatgttctcacttataagtgggagctaaatgatgagaacacatggacttatagaggggaacactctgggcctattagaaggaggagggtgggaggagggagagcagggaaaataactaatgggtactaggcttaatccctgggggatgaaataatctgtataacacacctccaggacacaagtttacctgtgtaacaaacctgcacttgtacccctgaacctaaaagttaaaaaaaaaaatttttttttaaatgttaagaaaacgaagaaatcaggacactgatgaattaagtagaatgaataagacgaagctggggacgatattagtacacaaagtacatgttgtgaactgctgcccatatgctggaagaaggcacacatgactagcaagcccccaaaacagggagatgtcaaatgggctgcagttgtttgtgttcaaaggtgcagaagaatcagaaccatttctgacactgagcaaaacttcccagggtctccacagcttcccacatgttctctgttttacctggaatgtccttccaccactctccacctggctaactctttttgaaaacactgttcaaaaatccctcatccgtatcctgaatgtttagttacctttctcctccatagtgttgaaagctcctcaatggagctttccaatggagctcctcctaataaacatgctcattataaatctaaaaaactagtttcttagagctatttttatagcttttcctactgtacacacacttcaggggaaaaaaaaaaaaccagctttatagttgaactaacacagtgcaacttaacacctgcaactaggggcctcacttcattcagagatatattttagcaggttagatatattgcaaatcattatacaactgtaggaaattattatttcaaccaaatatttgatatgtgttaagcaatgatgaatttgaagttactttaatgtatcttgagaacagtgattctatgttgcttctttaaatatggagcaatttactttcctgtcaatggaactgggtatgacattgacttttgtaaggtacgcaggcatgcacctgtacctgggccaaaggagatcctactccagcatgcagagaaatgtaaaatggctttaatcatgccagaaataaaggctgctctaattggatgttttgtctttgatattgtctctttccttgattaagctattagctatcacttcttacaactctccaaatacttacatactcaaaaatttccatgtgtagtgtaagttagattagtaaactagatatttaagcttattttaaaattatctaagtaaaaatatgatgtacctcatgtagacctaactgaatacattctgatgagtatgagatggttaaggtggatattaaacctgcttttctgccttgagagctcttctaccactccacatccagttactcaacaagctacagcatttcgcttctgaaatagctctgctcctgttttttagctgtctctttatttgggggcttatgtcatcttacatggcatattgcagaaataccctatttggtctctctgtcattacccttctaatccaacctttacactcatcttttggatacctttcataaatgcaaatctttctataaatacctaacaaccttggaataaaagccaaattcttttctcactcagttattcacacaaatttttgttatgtgtcatgcattgtgttggatgcttaacaacacatgcgaaatctttccaagattgtctcccttgcttcaactcccagctttcccccactcatagtctatgagtacatttattatccagaagtatgaactcctccagaatgcagaatattctctcatatttccaattgtttgcatattctggtgcttccgcatgaaatattcttccctcttgtccttttaagactcatctcctctgtaaagacttcttgtcacttcttcccatccttaggcagagatagagactttgttttggtgctcaaatagccatgttttcaatacttgcatgataagtttaatcatggtgtttgtaactttttgtgtccttgcattattttttctaatagattgggaagacaggggtattatcttgttcatcttgtgtccatgacaaatagtacatgttcagttaatgtctactgaagaaattactgagttatcacctgcctgctttcggtgggcaataaattgatggcactaccatggtccaagccctattgtatgtcatgtttatttgcaaaattgccttctaccttcccttctgattagattgtaagcccttgaagatcagggagttattactcatgtgatacctagaaaaatgcttagcatgtagtaagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaagggtacactttcttcaagtgaagattctgagggcagaggcaaaagaaacacagagaaggaaatgaataccccttctcccatcataactcttctctctgccagtaaatttgacagaacttgggaaatatttgggtacagagatgtagaaaaataagtgaaaatggcttttcaatttttaattacccaacatgccattggtgaagataagaattaaaggaggattagttttcacatttcttttcattgattactactttactgatatataggaaataaaatgataaattgacaatttagatatatgttttcaatttaaacatcttgaatatgaaatgcctaagagatatatagatagaagcttcaggactttttagagatttcaagtaaatatggtgtgtgtgtgtgtgtgtatgtgtgtctgcatgtgtgtggtgtgcgttggggtgaatgtattactatgaagtataatacaggggttaaaatctcacatatctcacatgttccagacagagaacatacatacataaagcaaaaccaggatgggggctgataggaatatgtggctggacaaaagggtcagtagctattaagctctggttgattactgccaaagaagaatgcaggccagtgtgaccaaatttggtgtttttccaagagaaactggaaaactatatttttgttcgttcaatgtcacatgaatatctgcaactaactaaaaattgaaattttatgatgtccaaataaaacacatatataaggcaaattcagccccacaggatactagtttgagacctctgaattaaagtcttattgggagtaaaagacacgtaacatgttaagaaattgaagagtggtctaagccattacataactggaagtcaaattaaataaaattaagtgtcaatggataaacttgtaagtattctggaaagggagagatcaatgttggttgaggtttaaccaaaattatgtgaagaagtggggctttgcctgaaacttgaggaatgattggctatcattggcaataaacaagggagaaatagagatgatgcttagggaagacagtgagtagcttattcttagtggaaacaaagaaagaactagaaccatttctcctaactcctggtttattgttttatcttccatgttctaccacctcctatttgatcttggataaaacagggatacatagaaatattaattaattaagcaaatatttattgagcacctactgtgtgccaaacacttgtctagggtataaggtacagtatatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacatactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgattatatattttatgtagcatttcattgtataaagaaataatatacatgtataaataattttttaaaaattggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaataaaacatctaagttgatgtttcaaactcaatattacttttaaaacatcatcaagcagttgaaagccatgccaaagagattagttaaaggctaggtgactgaatacgatatatgtacttacaaagctttcattgcatagtgacattctgttcaaaacatactatgttgctggcctaacctttccatctgtttctcacagtcttcttatccaggtagttttccaagacatacggaatattagctatgcactctctaaatttaccttgagagagatcagatccatatcataagaaaaataaagtgtcagcatgaccatcttaaatctgtatcttggatattatttttaaaagctagtctttcatagctgacgtactacataacaaatacaatacattttaaccttattttcctgtgcaccttccacaaatccatactgcaatcacgaaaagggatacaaatcaatattcacttaataattttgattagaaaaggtataacccaaaggaccattccagtattgaaatttcagtaatatttcacctccctcagtcctatttctactgcatcagcacaacattatctcagctagcagccattaagatggttttctctttcatgttgatgctcttgcatacattttacagcctgctctgatggaatttttatcttcgcaaatgtatttcctaatttgtctatttctgtgtccagtaaactttagtctatagactaagaagtcaaaagttatagctacctttaagttacataactttagagacagaattttctacagtgagaaatttaacatactttcttaaggcattttggtgaacaataaaactttcttgttaaatttttgctttgcaatttacaagaattgggaatttggggtgatttgagaaaaagaggattattcaatggataccacctgcatcataaggctagactaattcttttgaaaggttaaaattggcagttactttaaatgatcttttgtcgacttttggaggtaacacagatgtctactacatttttcccagtgaatgtgttataaaatttaactgtagggtagtgaggctgtggattcagagacataataaagctatttggaaatctgggagattttgttttgttacagtagtattttccctgaagtcccttagtcaatagaaggaatgcaatttcctaggaactgcagattactttatatgggtgattgacaatttataaaacttgcatctttcctaaagaaggtttttatattgcacagatattttgttcaccacaagcaagattaaaataagctaatgaaatatgcaacttgttatttcacatttagtgactatgaaataactgctgctctcaaagaaccaatctgtcaacctccagaggactaaatagtgcatgggacaggggacaatcataacttagctagtcaaatgcattttttgtcttgtccgactatattattagatagtattggtaaaattaagatttttttaattaaaacttttactaaaagcttctatttcaaggaatttttgactatgaaatggaatataatggatcaaatttttaaaatattaataggttaatatttttatattgtgcataatcctggttcccaaacagataaaatttctatatacaaagagtttagttatggggggtaaaatgaaaactttaaaagaaatattttctatttaacaaagacgtacaggtgactcttagttactcaaggtaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaatattttaaaaatataatttacataaagatcttagtggtaggatttaacagattttgacagatgcattcaacggtgtaaccaacaagctagtcaacagatagaacatcttcgtcacccaatctctttccagtcaatctcccctgtacccagcgcatagaaaaccagtgcttccatttttatcatcataaattggctttgtctgaatttcatataaatgaaataatatggtatatacttagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaacataaattcgtagtggtgtcagtcaacactgttacatgacctttttcagaaaattctgagctgttaaggagtaggttcagaagaatcagaagacatgatttagtcaatgttagtcatgggcaagatgggttcagcagaagatcagctgtggaatgataattagagccctagtaaaaatatgtagagaaaaagagataatagtaaggattgaaggaatggcatttactatgcataagacatttctgctcactgattatatgttgattggactagtttgttaccagttttagcagaaaatctgaaagtagccctctctagctcatacttcagttctctttccagctttaaataattaacttgtttacttgaatctatcaaggttgataatcctcagcaagtttaggaaatgttttacttctcctcctactggtttttttaagtttctacacctactggtattgtagataaacattagtatgtatttgttaataaaatcttctttcaaaaaatttgaaatttttacagtttttcatccttcacaaaagtatctatatttcagattaaatctgaccagaagtctagaccgctgtgcattgccagaggtaaatagattctgactttaaacacaaggaatgatacagcaagaaaaagacagttgttgccctagaagcagctctacaatgacatcactaacagtgatgctggtttctaaattgtcatctactccataaaacattaattttgcattcatcttttattgaaagcagtccttatacacagtttctattttaaaaatatctattttttaaaatttattgtaccatttatttcttggcccttaagtgctagctcaaagatcatgatgacttattatccctgctccatgattatgtcttcttaactgctcaacaatttggaggagctcctgtccttgtgggtctagattcccccaattttcagtgcttgctccacctagtaagtgtctttctgtgcatcttgaatgttctccaagagagcgtggatgaataagccagtgtcactacatgcttaagtgcaaatagcagccatttcagcaatcagggacaagagatcaggcaaaagcattctttaacattgtgcgatcttcacatttttatttaacgattactgatttattaaagctgcatatgttcagaagattctgttccttgtacaagaagtgtttaagtgcttttcttatatcaatttgttctttctggaatttttttttaaatcttctcttccaagcttcattagttatcaaaatcattctttttcatgtgccaggatgtggcccaaaggttaacttgtccatctaacttaatcaagaggtgactgtactctggtatccctgagacatgcagaattaaaaggttataaaccctgaatgtttagaacattgtttcagcacatattaattagtgacaaatgacctgaattgattctatctatatccagttcaaatgagcaagcagatattcgacttttagcttctaatgctagaagcctggatgttggatttttttttcacaaggagactcagtgtctagtttcaacagcttgaacaagttaggcttttgattttatcagtctcacacagggtgagcagactctgcagaaatgacttacattaagtaaggctgtcagaaactgatttatagagcaaaatggcattttatcaatttgcaggtagaagagaaagagaagggactttgcaactgtgtagaatggagtttaattctcaactttaccatttaatagctgtgtaactttggagatgtaatttaatctctttaaatttatttttcccatttctaaaatgagtataatacatattcaggactctggtgagaattacataggctagtatgaaaagtgcctagaaacctctctggaatatactatgtgctaagtaaatattagtttctttttcatcatttctattgagaacagaaatgtttatctagtaagagtttggtgcacttgtgggtggattccttcagaatgtcagcctacaaattaaatagttatttcgtgaacatggaattacacaaaggatgatatttttatctagtacaggattaatggattgatcttctttaacctagaaatgtctctgcgtggattgctggtattgaacattattagccttaaagagcctcactcatggagaatgtgagaggcacacagggaaatgttgactatacggcgctcctttttaaatactcctaatgagatgttaacttctcatattataatcttacttagaagatgacattcttagtttatttgactcctaaacttttgggacgagtacttaattagaaaaatattataggatcttcaatgaggtttggagataccttaaaattatcagaagtgattagggtgtggtttctacattttcatgttggttcttactgactttaatttctgatgattttcaaaccctgaaacttattttgtatcttcagtgtacatagttaaaattacacttaaaaacaattaaaatgaggtatctcattttgcaaaatagcactgtggctcatgtaatactgtacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcaataggggagcgtctgattcagactaaacatgtacctgcaaattagtcaagaaataatgagacaatctgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcataaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacataaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttatttttctgatttcatgtgctatttatttattaatcttgagcatgaatgcttatgtttgagcatagttagatgctttaaaatccatgcataataattcaagcatttgggtttcaaaagaaccagttcttttgaactggtcattttggtcattacctgtttacagtttcttttgattggtcattatatgtgagcattgtcctgcttcttcatatgtgtatcaattctgtatcatacactggatattgtgaattattgtagagactttggattctgttatattcccccaacaagtattgcggggttttttgttgttgatacttgtctgtttaataaggcaatcaattcaatactttgtgaccactgcggtaggcagcagttgaaatttctattcagatgttttagccttagtattttaagagtctgtactgcacagttcagagttctgctagatattaggtagagtttacacacagcacttgtccttcttctccctccaattctctctttttcagtatttcttctcctcgctttccaggtgctatggtggttccaaactctatttcttttaaaccagtgacaccatgaacattatttatataaattgaaggcaatggagacagaccaaaagtaaacagaaagtagaaaaaaattaaaagtcaaaacctagaaaatgaatggccctaggtgagtttgggtgagtttcttgtttttacaggattttgtctgaggaccaaataaataactaaatgtttgtacaaaatgtactatatatacatatttattccacaatttgtagcttagaatttgtatctgtagggaagttggtctatttggaactctgaaagcagaactccactccaaactttttaactgctgttatcaccttctggaatatgtccttttaatatccctcaaatttatttcatattatcccagtttatcaaacatttaggacccaattgtagtcgtaaaggaatctttttcttactgttctagctgacagtgcaatcatcatctcatattggaacttaaattccctggcttacttcacctctcagagccccagttttcaaatctataaacacagaaataatcattcttacctcataggggcattatcaatattaataatacaatattatgcatgtatgtatggtatattttatattaatataatatataatagtaacataccataccatacacacacatttatatacacacatatacatatatgtgtgtgtatgatatgttatatacatacacacacacacacacacacacacacacacatattagcatggttgatacctggtaactattcagcaaattatgggtgtaattatgggtttaacgtctgtctacaatttttacttaaattgaaaggcatgcatttttcaattgctacctaaagtctcagaaggctgcaatcaagtatgaaggccaagatgagaaagagtttatgcatttacttgataactcaaaaaaaaacacatatggtaaattattcttttgtgccacagtaaatactgaatatattggtgtcaagcaatggcttaattaataggataagaaaccatgttcatagaagttaggaaacaagtgtttaggggttaaattataattaaaataattgacctcttaataactgaaaatggtctgtacctaaaaagttggtataaagttattataagtaggattaactatcattcatcagcattttgtaacactcagatttgaaagaaagagaaaaagagagcgataaacaggatttattcacaagagaaccttctgtggcattttctgaagattagaaataatcagttctaactcctaagacaacctataagtgtaaaataataattgatatttataatgatgattctgagttgcacaatttaactcatcaaatatgttcattcccttccatagattatacttaataagccaagaaggggattctcaatcattttcaaaagatttttaataaggaatgaaattttaaaaatgttttcctccctggtttactttaaattcatgaggaaatttaatgagtcagatcatcccatttccaaagcattgcactatttgttagggtatacttttttaaacctccaagctgctctgtgaaaggttacatttatttttatgctaatttcctgtccttacactcaacttcaactgccaaaaaggaatgagactgaggaaaggagaaagaaaacaataggaaagccatttattcttatacatgtaggtcaacttattggtttatcgtcatttaatttgaatgtcacttggaagattttatagtgtggaacagatcgaagttgaaagtgtggggaataaaattttttattgttcagtaactaaatagttcttttttggaagccggaatttaaatccagtctggtcaaactgttaaaagaaaaagaaaaagtaaacataggaaaaggaaatttatgggatggaaaaatgtcattttctaagaacttcttggttgtaaaaatcctgattattatcccacaaaaaagtgcacaaatggaaaatgggtccaggtaaaaggggtcaagtttagcaagacaaatttgatggtgtggagagcttccacgtaaatacgacttcattttagattagttatgttctggggtgacgtctgttatggtgagatagctcacaaaattggtgctggagctgatcagctgcgaagtaataagaaaataattcattttgtgttttttaatgatattattggattaatcatgaaaaacgactttttggtttttttcaaatttatttattttaaattgacataaaatcatatgtatttatcatgtacatgatgttttgaagtatatatgcattgtgaaatggttaaatctagctaattaacaaatgtgttacctcacatagttatcatttttatggcccaaacccttatacatccactctcttagcatttttcaagaatacagtatgtcattattaacgctagtccccatgctgtacaacagatctcttgaagtcattcctcctaactataagtatgtattctttgaccagcatcttcccaaccttctctcccaatgactaccccagcctctggtaaccaccattctaccgtctatttctgtaagatcaacttttctagattctacatatcagtgacattgtgcagtatttgtttttctgtgcctggcttatttcactgaacgcagtgtcttccaggttcatccatgtggctgcaaatgacaggatttccttctttcttgtggctgaatagattatcaccctcatgtaggcctagtttttttgtttgtttctttgtttgtttgtttttttaggcagtgctactgatgctcattcctttatgaattaatttctttatttgaacttttctggttgggaaaggcaatatacatagaaatcactaatacctgagaagaattcatttccctaattgcttccttttatggaagaagacagactgggaaagctttaaattctaaagtttaagtcttttagggcttgacatgacatcacatacccctttggaattaataggaagacaagttgccttgataatcctaaggttatcatttctgctgtgaagcaggacaccagcagctagcaccctcttaattgttgtatcaacttaagtgtatgtaactcatttcctcttattctgtctagaacaaagaaaaacaatgtgacaatatacctgttttatgggtctagaaactgaggagcaaataggattgtaaacatgaaaagatcattttcaggcactttcttgttccaggcaaggaacattcttgtacggattgagatgtctgaaaatcaaaacactgagtaatttaccaaaggttatatttcaagtagtgagagctagaacacacattctcaagtacagtggtattttattgccaccaactactgtctgatcttctcaagattcctcaactttcttatctgcaaaataaggacaaagataaaaatatttaactcaaaatataattagcatgattcaacggaataatgtataaaaatgattagtggtgctgtgtgtatataagataataatgctaataaggtgggcccatagtaattttttaataactattctcttttaatacaaaaatatatactgcaagactcacatgttggttggaaatttccctcaaatcacctactgattacccttgatttcccattgtttttagtttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatgggttcaaacagcccatttttggaccacaacaacatatatgtctagcttactttaattaccttacttcaaaaagtcttgatgttacaagaaaatacctgctttttaacatccaactcccttctaccagcatgatcttacttcctccttctccagcctgtatcccatggtcttttattatagttagatccttacaaactataactctcttgtcctttttatcttccacttttcttacttagcaaacccaaacctctataaatccagctatctgcataccctaggcttaaatacaaactggtaaacatagctggataagaattactcaagtattatgacaggtttcatacaatgtgcatgaccataaacctcagattaacacacaccacagctcagaaaccctgcagtctggctctagtgaattcctttgttatatgcttagagtttctctcaaagcacattatgactaaggagtgtgtgtatagggctcccatccacaggatttcatggcacattccatcttctacaccactctaacccactgaagtcctagaaaggtatttaggtcaattaagccactagacaatgtgagctgctgataataaggcagagccagacagttttgttttgtttttttttttaaagttaaggtggctgccttcttgtgtctgtcacatctaattattcaaaagattactgccaaggttgagccatgcttttaagggtcaaccactacataattaccaactccatcattatgaatatgtacctgtggttccatcagtgcctgtgggtctatcactaccacaggtagtagctaaattttgtagcatttggtttcattctcagtaattgggaaagtatcctttgaggttttagcaattacccaaagcatatgctgtttttccaacaacatcaaatagattatgtagactttgttacaagaattttgatgctgttctgttacttgccctcccataattttgaattaaagatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgcctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatccatctactactttgaaaatgaagaaagttgagatcattgacaatgaacatactataattttaaatttaaatgtttaatagtttacttattataatttatttataagaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaatttaattatctaacaactatgtggttgagatgtggctggtgggttcatctcatcatacagttcgaatatatagccagcatcacccatttagtccctgcagtggctgaaaacctggcaaggctttttctaacctgcttttctccttgaagatatttgcttacattgtcaataggctaagggggttgttttgaagcctggattttgaatttcaactgtcaagcatagtctattaatgtagaaggttttaagtttatagtttcctcaatgaatgcattttaaaatggtacagataactctatataatatcctccatatgaatttagtttatatgctagcaaaatttaaatgagatttaaaaaatattctggttgctctgaggagaaatcactcaggtaaatctagaaaaataaaacagtaaattgcaatatgcattctgttcatctgcttcagttgtgtacttgcttgaaactaatttgctggctatgttatcacttccctttaaaatggtctttactgagtagagaaaatatatctgtaactttttgttaattggcgcataagttttaaacacagaagacttcatcacgaacacataatttggtagtaaaatttttttagcatcaaatgtaactactttataaatttcatgctcagcaaaacatttgattatttgaataagtttaaggaaaaacacttttttaatgttgtttctgactattggactagtttttaaaactggtagctcatatctgtcatagcttctcccagtttctcaggaactttacacgcttgtgtacaccctttccctctgaactggatcctggcccccatcatgctcttaaatgtcccatttaagataaaaaatagatttccataactttaccttccccaactcttctatcaccttcttcttccttcctcttttacacccaaactttttgtaaatagctatctataactgctgttatgtccccacatcctcattttctatgcatacctttctcctgagggtctaattctatttcaagtttcagccctccacgaaaatgattcctcctaagaccaacaatggcctgtatttctaatccaatgggatttctgagttttcattttcatgccttctctggtgcattccaagctattgatgatttcttctttgaaacaccttgttcctgtaatccaacacagggcacaatactggtttctttcctaatcctgggtttcctttgctgctcactcatctacctacacttccaatgctggaattccttgagcctccggcatatgtttctgtaccagctctcttcttcctctaaatgtttccattcacaaccatgactaccattgttatgtctgtgttaataatgctcaaatatatacctctaaatcaaaacacttcactcatgtccaaacctaaatttctcctcagaatgtctcatagtttttgcctaaatttattatatcccaataagtaccccatcttctttcacagacttctgtcttttccatcttcgccatctctttactggttccagttagtatactttactggttccagttagtatatttattcaactgccagttaaggattatccctgtacgaaaataaatacaatgaataaaacaaacaacaaaaaaaaatcctgtagcagctcaatttgagcaaaaatatgccatctcagtaagtggcatatccacctttggttgctcaagccagaaacctagaaaacatttgttcacctttgttctttcgtttagtctccaaagacatatacaatttcttcccattttaagtaccatgtctaaaatgtttcaaatgttgatatggtttggctgtgtccccacccaaatctcaactccagttgtatctcccagaatttccatgtgttgtgggagggagtcagggggaggtaattgaatcatgggggctagtctttaccatgctatcctcgtgatagttaataagtctcacaagatctgatgggtttatcaggggtttctgcttttgcttcttcctcatttttcctcttgccaccaccgtgtaagaagtgccttttgcctcccaccatgattctgaggcctccccagccatgtggaactgttaagtccaattaaacctctttttctttccagtttcaggtatgtctttatcagcagcatgaaaatgaactaatacaaatgtatatgtattttagaaaaattgaaaaggaaaattcccttttatatttacccacatatttaccttttctaatgctcttcatttttttcagaagttttgagctcatttggtattaattcccttcagtttgaagaactaactttagcatttctagtaatataggtctatctgtacatatctttattttgctttcattctgtaaaatattttttgttgaatacataattctagctggattgatatttttctttcagtgctttaaagatgttgatttattgtcttcttgcctcaattgtttctgattattctcttctatgtaataggtcaattttctcttgcccattttaatattttctgtctttgttttttagaagtttgactatgctgtgcctaagtttggctttgttctacttaaactgcttgggatttactgaacttcttaaacctgtaaatttgtgtctttcaccacattgggggaaatgttggccattatttcttctgcctcattctctctctactctcattcttgcattgaagacatttatattacaacttttggtatcaatgctcagcttcctgaagcactgatttttttaatgttttttccactttttatatgtaatatgttttatctctcttgaagtttactgattcttcagtcattttattctgctattaagttcaaatatacagtattagatattttaaattttactcatagacttccatttgtttcctttattataatttccatttctcagtaatatatcttctgtattaattcattataagccattttttcccttgatatcatgagactagcatggtaaatattttaaaatagtgtgagctaattctaacatctgtgtcatctttggatcattctcccttgattttttcccctgaaaattgctcatatttctctgtttcttctactatctagtaattttttatcgtatccttgacattttcaatgttatgttaccacttcttgggattctgttaaattcatctcaagagtgttgaattttgtgtatttgttgtaacagccaattaagttagattcaaggctgctgttcttgtgcagcagcttaaatttttgttatgttcttttaatcttctacaggcttcttggagtctgttcatgcatatatgatttgaggttcagacagaaatttggggagagtttatttacagaattttatgcattgcctctatagttctctcctctccaggattcccccttacaaaatttctagtagctgaggcagcccctctcaagtcagaaagtcaagattttttaacagtgattttagttatctccatgactcccagtgcagtccatacacatacgcaaacacacacagaaactcaccagtgccattctcttctcccaagaattgacaaccctataatagaatcttccactggttatatttcagtgcttttgagcagttgtttcttaaattttttcatgtgttatagttatctgtgagaggatcagtacaataagagcttttctagtcattactaaaggtaaaaactaaactctgcaaatatattttagccactttgtatacatttataatacttaaagagataataaaaagaaaaggttttggagaagaaatctcaagattgtgatttttttggaaataaatattttacgggaggcatgaatgatgatttagagttctctgagcttataataaataacctcagattggtttggtttttaagttctagaattaacatgtataactttcctagtgccacttatcaccctcctattttattggtgtatcatcaagccagtcactgaacatttacaggtttttaaaaagaatgtattgtgtctagtctataacagatttaggaaacgagataatagagcttgatagaagtgtatctaaaataataagtattttcacagtaagatcacaggaaacttttctttaaataaaattcatattctatctgacttcaaaattttcattatgtttggtaaaaacaaaattagaaaacatttcttgtagtttgtgtgtatgcaatatttatgacttatggtaattttctcttctagtcattcatgttattaatagaaaaaccttaccaaaatgaggcaaatatatactacaggataaggtcagaaagtataactatctaaaactggtactaacaaaagtcagcatggtgaatggagatagtttactttttagttgatgagtttaagaaaccttcctaaatatcatcaaaataactactaaaatatcatacataaaatacaatatttaaattgctaatattttaatgacatgaaaatgcttggagcacagcagaaagcaaatggaacatatgaatttctggcttttcacattattttctagaaagagagacaacgagcttcagacatgcttttagaccacttgacaaaaattatatgtatacaaacattgcatatgaagtctgctttagcttgttaacattctttataatgaccatcatatactatttattctgcctgcatgccttcatgcaacttgccagttcattcgcatctgcttgtcagtttcatgattttttggaaaattagctgttgagattttgaattaaatagccattccctatgaacttacatggtgtttatcagtcccttaaaatccaattacacatactgtttatgtctgcaaagctttgaaccatacgttatactatgggaattcaatttatttgtgaccagtctaccactccctacacacaaagcacaaatcaaaataggttagcctttatttatagcatctttacattccttaatttccatccaaacaatctgaatatacacattttggcataatctgttaacaaacaaattaatgatgccccccaaaaaacacacagttgaaataagaataatttaaaagtttattcattcattgtcctcaaatttatttggattacctgaggtctggagtttgagaccaacctggccaacatggtgaaacccagtctgtactaaaaatacaaaaattagccatgcgtggtggcacgtgcctataatcccagctactcgggaggctaaggcaggagaattgcttgaccccaggaggcagagggtgcagtaagccgagatcacgccattgcactccagagcctgggcagcagagcaagatgttgtctcaataaataaataaataaataaataaataaataaataaattgctgctctagctggtgttttttaaagctcttgttgctggagtgtttgtgtgtcaggtgtgtatgtttctgagtgtggtgtgttaatattgtgaagtctgaaatattttctaagaggtggtttgagaatgaaacagaattctgcacctttgactcaacagaaaatcatagtgctcagatgcaagtccctccaaagcatggcttcaccatggcagtcatctggaattgttgtagggacatgctaggctaacatgtagcaaaacagatcttggggtgagaacttatgtcttccccatccatagcagaaagctagactttagtttttttaagctgttatttgctattactttgaactccctgtaaaatttatgtaaaatttcacataaaaagtattttctgagaacaatttatccatgttgggaaatgcttactagagatataagtactattgtttgttttcctgatcttataaagtaattcagcagaattgctttctaggggattctttcctttgtttccactctagtggaaagaaggcaccagagagtgaaatcctgttgtctgattgatgagattctgttccggctgtgacagtgcataactcctctcattgccctatctgttgacccccagagaggctaaaagtagcacaaccttgggatataagaaggtttttgtttggttttgtttttttactagcactgtttacaaaaataggaaccatcagcagccttagggtgaaaagtgaaatgtatcttttacccagaaagttaaggaaaaaattggtggggtcagattgcttaatggggctaataaagcaaatgccactagatttggctcctatataagacacatacaaatattttgttttcccaaaccaaaaactgagtccgtaactatagactataatcaacttttaaatcttactcactgattgcaagcagaaccaggggagactttgattactcacagcttaatgttatttgtcttcctatactggaaaacaactgcaatttcatttttcactgatggaattgatggcttattttttaaacttctgttttgaagcatagaacatatgtagtgctgattatgggtcaccaagttaaaaatgtaacattaggtattgaaggacttaaaaataagtaaaatgaagattaaagatggtatgtcattttaaatcagtaagtttttcttatcttttataagaagactaattctacaacaagtccataaatacagttttaaatgatatccttacaaaaaggaaccaaaccgaggagattttgttggttgaatttctccacatattacattatgtgaattaagacagagttaggaatcagaggttttcttttttggaggaaaagaaataagtctaattttttttaaagttatgttttttctttatctgttacttaggtatttcctaattttttccttataaaatcataaaggtgttatttgagctatttggccaattcattaaagataaatagtttatatgtttaatttcaaaatgagaattacatttattcgctttttcactatttactgaattatatcaggtaatttgagagtcaacaaaagtattatttaacagatttcgtagccgtagactaattaaccctaaaaagaaagtttaatggaaaacaaatgaacaaaagagccaagaaatattatttgaaaactgatcattttccactaatattaattcgtattttattttattttatgttttttgagacagtctcactctgtcgcccacgctagaatgcagtggcacgatctttggtcactgcaacctctgtctcctgggttcaagctatcctcctacctcagtctctcaagtagctgggactacaggtgtgtgccatcacgctggctaattttgatattttttgtagatatagtgtttcaccatgttgcccaggctggtctcacattcttggcctcatgtgatctgcataacttggactccaactgctgagataacaggtgtgaaccaccattcctggcccttaattcatattttaaaagaaaaatttcaaaaatctcaagtaagagctttttttgtttccagagaatatattaggaaaatttgaattattatttttactctcattattttagtatagtttgtccatttcagaacaaataaattatataaaaaccaccagacaattctgttcattttgaatgataccacatgtctgagaccaggccagaactggaacacaccacacaagaagggtaagattgaagcttatcctatagcttttgataaagtgtatttattcagcctatactttatattaaaacacaacatccattagaattatgttgttctataaatgttatattaaaaagcaatgtaatttgctagttaattgtttcaggatttgtgattgaaatcacaaatttcagaatttgtggagtcgtctttctctgtgagtcactaattttacaagacagcaatctgaggtgctttagaaaaaaatcatacccaagaacatgtaagtagtcatggctacctgaggagaagggaagccagactggttttcatagaaacaactaaatttccctttgtccccagccaatttcccccctgattctcaatctaaggggattagtagaaaaccaactagattataaatgagtaaatgaatttagattttgcctaggctttcatttttcagaaagatttctttgacttccaacttggggaaatttacctctcatatatgcctactgctggaagatagcaggcatcatgtattatttctttgtctctcttcatttattacaataaagtaaatgaggggagaagctatatcttagtcatcgtttactcatttctgtcctatttattcatcaataaatatttgcagagtgcctactatgtgttaggcattaaagtgagctgtggtaaagagaggaaagggtgggaggacagataccagatatcagtaaaagaaagatattaggagaactttgtgattgattagatgtgggtggctgagagtagtagcgaaacccagggtgactcccaagtgcccaattttgttgcttgtatagatggtcaaattagtgacctaaagaaaatgtacggagaagcttatggaagatagggtaagaaaaataagaaaacaattagttctgtttgtgcctgtaaaatgtctgtgaaacatccaggtgaaaaagatttgtgagcaattgcaaatgtggggctagatcataggagtgttgccaaagctggatatgcagtccttaaaagatccctctaaaaaaggatgtggttggtataatctaaacaactgcagtcagagaaagagaaggatcatgcaggagatcaagataccatggagatcaaacaaggaatgtgtgttatagaacacatgtaaacagaagttgcattggggtgaaaagggatgagatgaactacacctaataatgaacaatttttatcagatttatagtttgctacgtatagaataccagagcttaacgtgcctgggattatacaaaacccaattaagtgacaagtactttttaacaacttacctgttcttagacaagtcttttattgtctccttctcatgttttttctttatttgtaaaaatgaagatatttgataaaatgatcagaaagctgtcgcctaacattaatatattacatacagtattagaggtataaaggaaagcgttcttggtcagaagcaatttcctaacaaaagtagacaaatatagccattgtatgtcaaatacatattatatataagaaaatcagccatgtaaggaaatactgaaatagtacaactaggaaagttacaaagtaactactaccatttttgctctactggatgaattacttttgttacatatactttttatatataattttagttatatatatatatttatttatataaactgggaaatcaaatcaagaatatctatgatccggatatctgtgatattccctttcaccagctacatctaaatggcatgctgccatacccaggattttaaagaaaaaaatgtttaaatctcaataatttaatttcagatgactgaaaggtcagtgaatcaaattattactagtcaatattaatacatatggtcatgggaggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccagaagaaaagctcttctcagccagaaaaacaactgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataagggaatagaaataaaagtaggcatagtctggtaataccaaatcttgcatccttaatgcatcatgaaaagatgcttgtggatgttttgtccaaatggctggcatcaacacccacatacaaactgctcctgctcaaaaaaatgcccttgtttttctctgagtacagcattgatatacatttggaagaaatcttattatagtcctgaaagaaagctagtagataatctagtttatttttgagattccagacagaactacattgtgtgtgtgtgtgtgtgtgtgcgcgcacatccacatgtgtgtgacagagagaaagagtccactgcataaccaaaaaatatgaatttggttcctagaatgcaaaaaaatatatctaaccagtacattttaacccagaaatgttcaatttaagcattaggtctataataataagtggaaacgtttgatcaactatcatttattcatttatttaataaatatacacatagtaaatatttattactattatcatctgtgttattgtatgaaaatcattatgttaatgaaattatatatttacatacttcggttttagattaagcaatatgatattgcctgtaagtgatcatttttacctcaaaaatgactgtttcatatttttctgcctagtatttgatttaatcactgaataatgatatatgttaattcaacagcttgtaaggtcaatttagtaaaagcacaaatttatatgaatgaaaataatggcctgcaaagttaagatttgactctgctgtagaaatggacacaaattacatcaatttaccaaaaagaatagttcttacaatcagagttaagcaagtacttgctcctcttggtggtttaccaactgccaaaataacagcaagatcagatttcttcatagaaagttattggtatgaaactttttggattaaacagttgtttctgtaactattaactaaatcattaaaagggttagcctatttatagtaaccttgaacctttttaaatttaatgttttcagatgaaagcattgatccttccatgcttcataaaatggcatcccactgggcagtgtcattagtgatagtcctactgggagagacacccgtccaaattattgaatgaagagcctaatatagtgaaagatacttctaaagtgcagcttgatgttttaaaaatgctttcatacataatggatgcctactgtactcagctatttgaggtgttgtagcacttactgaattttcacataaattgctgctctctgaataagactattgtaccagtttataaggcttgatatattttctaccttccaaatgggcattcaacgaacttaaattttatctttatattgtacttaactgtaactcagtaatttttcttaaaggaggagaacaaattgtacaatacagtccatattagaaggaattagcttttgtttttaaaaagaagagaatgtgttttatatcatttgacattttcaacttataaattttagcaagcatgcatccattataattacactggttttttactatgtaatttaccacagaacagaatacatatacagacagttaaattaattcattagataggggacatataggaaagtcagcttcttatagttaaccaatccaaatatattcataaaaatatagatggaaaacttgattcaagaaatagtttccatttatctttcaacagtagttttcaaattggttagcataaggtccaactttaaatggatgaattatgttttgaaaataaatacttgcatttaaatgattattttcagcagtgaattattcttcggctatctctctgcacagagcataagacatttatttatttatttatttatttagacgctttgctaggctaagattcaaaatgggttactagtgaaggaagaggagttttgcctagtttggcaagagatttatctacaagctctataaaaagacaagtttttatttggtgaaaccagttaagatgcaagagttggaaatttttgagttggagtaactattttttaaaaaaactaaccatgaaaaaaattctggggtctgttgtcattttggataacaaggatccgtcccattctattctcccatctacatccatctcccagatccttatagagagttatgcccaagggagattccaggtaaattaataattttattaccaattatagtctactcttaaatctttctgtgattcctgcccttggctagctgcacagaacttccatctaatagatggagtgtacatctaacataaggccaagactaaaatcaaatttgtggagccaactccatgtttccttctccctagcttatgtcacaggtttataagaagaaaatgaagtgtttctgcccccaggttctatcagctacactggaggaatagagaaaaaaaatgaaaatggacaagtaatctaagagttgtaggagatgtcaaaataggaggactagaaacagaagagttatcaagttctttttctttcaccagaaattatattctcctagcaattatgactttgtcatggctaacattagtacctcttaagagtaagtatagggtcagagagggtagaaggtaaaactgagttttttgttctaaccccagaagtgagactacaaagactttcagcgagaaaacaaaaccagctcaggagagctaattatttactagagaaaggctaggttgctggtttaagaagagttcccagattgagccaacaatgaccaaggggcttgcatgagagttcctagattgagctactgttacagtttggatttttcagtcctccaaatctcattttgaaatatgatctccaatgtcggaagtgggaccccatgggaggtgtttgggtcatgggggtagatttttcatcaatagattaataccctctctggggattgggggctgtgagtgactttttacttttgttaggtcctgggagaactgcttgtttaaaagagcctggcacttttcccaacccttgttttcctgtctcaccatgtgatctctgcacacactggctccccttccctttctgctgtgaatggaagcagcttgaggccctcaccagatgcagatgctgggtccatgtttcttatacagcctgcagaactgtgagccaaataaacctcttttctttataaattacccagcctaacaaacagactaagacagccatcagtggtcaaagagcttgaacaggatgccaccagcctgaatataaaggccaatccaggcagaaatggagaccaggagagctccattaaaaactaataaagctttaatttagatacaggtacagtagcaaaggtggaactgtgaggtacaaataaatgggaacattactacaaatttggataaagacattttagaggaatctaaagaagaataaatctattaaacagcttttacactaatgtgtgggaaaagagtgaattcatgaatttcaacagaaaacaaagtaaaagagagacaggaaggaaggtaggaaggaaggaagaaaggatggaaggaaggggaagggaaggggaagggaaggggaaggaaaggaaagaagggaaggaaagaagggaagggagggagaaggagggaggggaggaaggagggaaggaaggagggaatgaatgaatatgtagacctgtgattaagatagagtacaggatgttaatgcttgattgatgtggtaaacgggtcgattcaccttgttggactcccgtattctcttctgcaaaatgcaagattagattgaacctggatgatttataatgttccttaaggatttaggaacttatgattcatgatactaaaccaagttgaataatggatccatttatctgttacaaacttgtttaaagcatgagagtttatcacaaagataaaattttggttaagagtatgttatacaacaaaggcatccatgaaggtggactgaagagtattaaagggaaaagttgagatccaagaacataaaaccctgatttcacagatggtagtaatggaagttcatccctgaagagttttctgttggagagtgttctgctcaaaatcaatgcatctcaaatttaatgtggatacaaatcatgtgcaaatattatcaaaattcggattcagtaggtcttagagggtgcggtgccgagatttttatttctaacaagctccaattttatatcaataagtaccactttgctttcatatccaagtatatattatattccaatggcttacagtgaaaaaagcaaatttatgtataccataattgttcagtcaaaagtcagacttttggccatgttgacaatgatagttatccagaactagttttgtatgagctgattcattctcttaaatacaggacaatagttatgatcacatatcatcaaaaataggatagattatattcaacatattatcaagtttgatggataaatcagtggagcattcaatgccttttagaaaaattgtcatctaaaatgtcaaagcatgttttgttaatataattatataattaaatgggtatattttaggtattttgaaatctttttcatccaggacattatatcatccagggaaaaatacatagcagaggtaccagtgtaaatacacatttttatgctgcctttaggcataattcaatatattttattgtactaaatggaagctacattctctgaacactatcctgacatagagaaaaaaatatattcctgttaaaaatataaaattgatctggatattctttgttacatattacttgaacctgttcatctctatcaccatttactgattttcacctgtgttatttttcacattccagtcatgccactaacactttagaaagtagaattagtgctgctgctgttagttcctaccattcagatctgattccaatgtacattttaagatattttgtttacctagcaaagtaactaagaagtttggagaagtgaggctaaaaaaatgtattatgtcttaggctgcaagtggcctctcttgcagaagtttttctttgttgagagtttctaggttgcaagtgtcttccttattgaggcattgcagacaagtttttattatctcacattttctaaataccaactgtttgaagtgtcttccattcctaccctttcacaagcattcagttgatgccttgtactagaagagtgacgtcaagtgactgtgctgaataaaatagctttaaccgttaaggaaagaaactggtgtataaataaagatatctgttcagatttcctttgtaccgccgaatcctcttagcctgtagtacttttgaaaatagaagtaaaagtattgttctttctttcttaagtacacacttgtgttctatgagtctttattttttgtatattttctgttcacatttgaagcactgtgtatgtatgtgtgtgtgtctgtgcatgtgtgttgtttgtgtgctgtttgggaggcatagttgggaagaaagcatgttatagattaggatttaggatatggtttctgaacattctcttgccccatgcaagtacaaactccagcaaggtagtcaaatcttaaagctccaaaattatctcctttgactccatgtctcacatctaggtcatgctgatccaaaaggtaggttcccataaccttgggcaacccttcccctgtggctttgcagggtatggccccctcctaactgctttcatgggctggcattgagcagcttttctcggcacacagtgcaagctgtggatggatctacaattctgagggctgcaagatggtggccctcttctcacagtgccccaatgggaactctgtgtggagttccaactccacatttcccttctgcactgccctcgcagaggttctccatgaaggccccacccttgcagtgaacttctgcctggacatccaggcatttccatatatcctctgaaatctaggcagaggttcccaaacctcacgtcttgacttctgtgcacctgcaggctgaacaccacatgtaagcttccaaggcttgcaccttgcaccctctaaagccacagcctgagctgtaccttggctcccttcagccatggctggagtggatgagattcaggacaccaagtccaaaggctgcacaaaacagcaagaccctgggaccaacccatgaaaccattttttcctcctaggtctctgggcctatgatgagattggctgacgcgaaggtctctgacatgccatggagacatttttcccattgtcctggcaattaacatttggctcttcattacttaggcaaatttctacagctggcatgaatttctcctcagaaaatgggttttccttttctatcgcatcatcaggctgcaaatttttcaaacttttatgctttgcttctgttttaaacataagttccatttccaaatcatatctttgtgaatacataaaacaatgcttttcacaacacccaagtcacctcttgaacactttgctggttagaaatttctcctgccagataacctaaatcatctctctcaagttcaaatttccacagatctctagggcaggggcaaaatgccaccagtctctttgctaaagcataacaagagtcaccttagctccagttcccaacaagttcctcatctctatttgagaccactaggcctggacttcattgtccatatcactatcatcattttggtcaaagctattcaacaagtctctagtaagttccaaactttcccacatcttcctgtcttcttctgaaccccccaaatggttccagcttctgcctgttatccagttccaaagtcactttcacatgtttcggcatctttacagcagcgccccactacccggtaccaattttctgtattagtccattttcactcttctatgaagacatacccaagactggataatttataaaggaaagaggtttaatggactcacagttcagtatggctggggaggcctcagggaacttacaatcatggcagaaggggaagcaaacatgtccttcttcacatggtggcagcgagaagaataagagctgagaaaagggggaagctccttataaaagcatcggacctcatgagaactcactcactatcacaagaacagcagtatggaggtaaccgcccccatgattcaattacttcccaccgggtccctcccataacacatggagattatggtaactacaattcaagatgagaactggttggggatacagtgaaaccatatcacatctaaaccagaaatatcacctatgtaaatttcaaatagctaaattaatttctgaacagatttttggtcagatactaccaattcctttgttaatgaagaaacctcttcccatggggtgccaaagtaaaaagacagaatgcataattgccaaaaaatgtaatgattaggagtgatttctctgactatttaaattttatttgcaagatatcattagtctgtgcttatttccatctagcagggtatatggatagactataacccaacatatgtcaaataattttggtgggtagctcatttgaactaatatggaaactcctcgaagacaaaaatgtaataatacattagcaatgtaatgctatcataaattagaaatgaaaaatgttgttctatttttggggtattaatttttcctactgaacatgtacattcattcagaactgtagaaacaaaaaaggggaaagaaaagaaaaagaaacatagaaatatgacatttgtcctctaaatttcactttttcaaaacttaattccaacttgactttaatatagtttagccattataagcattctacctaatgaatttttaagagcatttatatgtaaagtagaaaaattattgttttgatttttttcattttctcagttctgcaaattaagtactttagatattttttaggtttgatacaaattaaatttcaacttatatgtaaatattaggtgtacattttatagttctgttctcagcactgtagtatgaggaaagcactgtgttgtatcagaagctatgaattatacaaaatcagaattaactgcttggatagccttttgcaaatcatttcacataatttggtctctcagttctcatcaaagaaattttcagaggctcggtccctaaataataactaagttataagaatctataggggtatgaccatgcttatgtcaataaaatagtaatgatggtgataataataataatcacatttattaagcacattctgatgtgccaggctctggtaagcagaataatgatctccccaaagatgtccagattctgttccccagaacctgaaatatgttaatttacatggcaaaatgactttatgatgtgattaaggttaagggcattgagatgaggagattatcatggattatccagtcgggctcaacctaattacatgaggccttaaaacagagccacttcctggccgcagtgaggaagacgtagatacagtgtggctggttttgaaaaaaaaaggcagaaagcaggacaaggaacacatgcagcttctggaaaatggaaaaggtaagaaattggattctcccatagagtctccagaaagtaacaatctgctgacaccttgattttagcccagtgagccctatgtcagacttctgatctccaggaactatatgacaataaatttgtattgtgtaaaccactgtgtttgtggtaatttgttacaacagcaatgaaaatttctgatgtaccaggctctctgctaagtactttatattagcttatttttggcctcacaacaactctaagaaataagggccattattatccccattattattaaggtttaggatattttaagtagcttttcaagctcatcacttgtaaatagtaaagccagcatacgaccccaggactgctttggttggataaagatgatgtccttaaaattattagaaaacgtatatctcaaaacaatttaagagttcttgttttcatttcctctaccgtagaatgaaactaatttttctttactaactgcatgctgaaaagaagggtcaatgaggaaatctctgtgagacatatgggcccaatgggggggaaaaagctattatatactttgtgtaaaattagtcctccttttctttctaaagtcatcaattttctatttttctttaatccaatatgttcagtataaagtcatcagttttcaaccttcttttaatcagaggtatttcctggtattttataagggaaaaataaaatgtgacatcactaacctgttatattgtagaatataacaatgaatcttttgttttataaagggcctgccttccttctttccttccttccttccttccttccttcttcttttccctttcttcctttcttctcttttttcggcctaagcaggaactcattcacctaagaaggaaaacaaagttgctccctcttaagaaagacatcctgctgattttgtcagacaacaattctttcttgctttctttccttctttctctctcattttgtttctctctttccctccttccctccctcccttctttccttccttccttccttcttttttttctagggaatgggtcttgttctgttgcccaggctggaatgtaacgtcacgatcatagcctacgacagctttgaactcctgggctcaagtgatccccccacctcagcgtcctgactaactgggaacacaggcacccaccaccacacctggctaatcttttcgtttttttgtagagatggaatcttgccatgttgcctaggctggtcttgaattcctggcctcaagtgatctttctgcctcagctttccaaagtgctgggattataggcatgaaccactgcacctggaccactgttttctctttactcttatgatgcccccatttatcttaatcttattcttatcgcaactcccagacacctcctgtcctcttggtgcactaaagcctaactttctctttgctcatacagactgagagagatctttttgcccggaagctttgaacattttataaactccttaccaaaataacaccacttaatctgtgtcatctgtggtgacgagcttgtgaaagctatgtggactctttggcactgcatatgataccacattccacatcagaaatctggagcatccagaaagtaatttagctccttgttttcctctttggtgctgaaagcccttgaaaccacttgggggctgctgatatctcagattctctataagtaggaaactttttgataaaaactgcagtaccagcaggaccttttagtgtgatgagcactagaagaatgaacagggtgaaatttgttttgttccacaaagggacaaaaaaaaaacaaaacaaaacatgaagatgggtatagacagaaagagaatctgtgaaagatagagccctggttcaaaaaaatgacatatttaaactcaggcaatgaaatagtgagacaacaagttttaaaatagataacagcaacataaataagaacttatttttatatgaagaacctgaggttgtacttaaagtatgcaaagcacggtggaataatacattttacacagcacgcactcagaatccgtttatgtctaaaattagcaaacaagatcaaagtgccatttactacctatggctgcaaattaatgattaaagaagaacaggttgatggttctacctaaaaagtaaaagaaaagttaagggaattaaaaatcacagtattgtagaataggtctcagttaaataatgcacatggatgttttccaaaagaaaactaaactagttctgctttccctctcttgttttttcttaactttcaacaattggctgttctcaaagcccaaatagttccattcactataagtttcaagtgcttagcaaaaatgctgatagcttcagtttagctgttttcggaagtatgtggatttttaaaatactcacttttttctgctatcagaaaacttaagggacgtatgagaaaataaatatgagccgaaaaggcctttttcatatgtgaaacattgcagagcataacaatacgcaagttccccaatacattgtagtttcctataattaaatacttatattcacatagaggaatatatcttacattttcaaattaggcgaataattttatagccaaatcttttagtttatatagaacccaaatgcttaatatatctttgttatataataatattttatattgtggtcttaaagccattcagaaaggactaacagtcatttccccagaaaagtcaactctgttacaagaagttacagagagctttgcttcttattttgtagtgtgcaaagaaaaagagaaaaatgggataaggatggagggaaagaggaaggaaagttaatactttgaatgctaacactaaacaggctgttacaaaagcgttctgtcctcctcagtcactgaagaggaaatgcctattttgtatctccctcattgtcttcgcttttgctggacttgtcgtaccagtcaccccagaagtcactcagcatgccccctctcattcactggttctctgcaaggtcttttgacattcttggtgttaggcacattaacagaacagagtgactgaggtagataagattatcttaaagtaaattgtgaggtgattttttattaatagaagagttccatcctgaagaaattacttctcattctgcttggtgcattggtgcagttagatattctgatagtccaattgaggtgtgtgtgtgtgtgtgtgtgtgtgtgtgcatgcgtgtgtgtgtgtgtggtggaacgtacagaaaagagacgaaaaagagcaatgaagaagtgtaataaaattagtcctcaaatatggaaagaattaaatggacgtttccatctcttctttcaccctattacctcattctaactattcttagcaggtaaagaaaaaacgtctttactctatttttgaatctaatcaatgcagaatagaaagtttatggtacccttaaggaaaagaattcatataaagtgtattctcacctaaacccccaaaaccgtaagaatgttttcttcttagtttctttaaaaagctatgaatcattttactaggaaaataggatttttaaaaggtcacagaatatactgaagacaagaaataatttttctttaaatactatataggatgaggaaatagagaagaaagagaagacttccccagccatttatgatgataaggaactttaagttcttttgccttcatatttgtataaatttcctaattggccaacactacaattcacaataacatgaattatataatgcatgtaatttcttcagagaaaatgccttactggatgtgtattgtgcactagttagccttgcttattattttttttaagtgaaacagcatgggttgttagcaaatcaaatttctttaaaaataaatgagcttggatagtctcctgatgtctacattcctcatggcataataaacgcccatcatggttttgtggtgacattcatagtttcaaatattttgtcctgctgtcatggtaagtgcattcatacgtggaagattatatcccaagtttgcatttagaagatatagtcactgaacccatatgttgcccatcaaaactttttggctcttactgtttgaaaggggaaattgggggcctgggtgaggtcgctcacgcctgtaatcctagcactttgggaggccgaggcgggcggatcacgaggtcgggagatcgagaccatcctggctaacacggtgaaaccatgtctctactaaaaatacaaaaaattagccgggcgtggtggcaggcacctgtagtcccagctactcgggaggctgaggcaggataatggtgtgaacctgggaggcggagcttgcagtgagccaagatcacaccactgcactcaagcctgggcgacagagcgagactctgcctcaaaaaaaaaaaaaaaggggggaaattggactatcctttgtgaagcacccaccatgttccaggttactgatatcgtacattcattatcgacttaatgctgaaagataagtgtgattgtccctgctttacagtttgtgaagtagggaggtgtagtggttaaatatattcaaagtcatatggctaggaagtctggtgtcagggttcaaaaccaggacgtttgagtttcaaattgctgggttttttcctccactctttatagtattctgcttctgtattctgtagtttctggtcacacaaaacacaatgtaaaatgtcagcataagtgggaagttttctaaaaagtaaatgtgtgaataatgtgctaagaaattcaggacccaggtctcaacactacatagagaagaataatgacatttgtcttgagtttggtatccttgacaccaccatgttttgtctgttagcctgccaaatgtgtgtgtgtgtgtgtgtgttttaatcatctttctctttattagtataatataattttacctgccttgatatcatgtaggcataaggtattagtcttgttccatttgtaaagattccaggagtgttctgctttttataacacttcaaagttttgtgcttggagctccactatccaagagaggcaaatggctgttaaggaatctagtaaaacattccaatataaaaaccttcaggggcacatggtgatccattaataaaacagaaattcaaatgaaaactttagtttaacaattaagatgatcctgactccttgctaaattcccattgtcttatgggatacaagaatgcaatatgagatattgtacaatgcctttagtattttttctaatagatttagttccatcacgaactgctaaaacagtgtgagaaaattcttgaagaagttatataaatattaatgtatttcagagttttgcttattgtattgatatatgttcaaaatgatgtattttttcagcaatacaaaggatataacttatctcacctttctttaggcaaatgaatgacaacaaattacaatagtacaatatcactagatatcttctaagttcagtgattaaaatgtacctactaaagagaaataatactttaatcactgtaaaaacccaagcaaagtagaatttttcaaagccctgtggagtggcaaccctatatctttaatatctaagaactagaaaataattttaaatatacatatgttttatattccttaagagcaagtgactttaggtgagaggagaccaaaacttaagtgaattaccatttaaagcaaaagatcaaactagaatgttaaattgtagcaaaaaaggaagaaattatgtgactctttcatactataatattaccagtttggaaaataggcctagtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcggagaggtagctgtttgatgtaattggtctatcaagtttaaatgcaaatgattaagtagggtaaacattagcagggatggcaaacagaaccaaaagcattttctcatggtactctgctggaaagctgatgtgatttctagacagaacagacagcttacccaaaactatctaagtacaaatatggctacctctttcttctacattctctctcacctgttccaattagctgtaggaatcctcagggagaactgcatttcacaattagattttagaattgccgtacccttaataaatacgggagcctttaatgtaatatctgctatcttttcttatttcaatttacctcacctaacaaccactttgttttcagagcctctttgtagaaggtcagtgtgcagtagattggctttgttcacagactacacaggatcctcactggaggttttgtttagagctcatatcagttaatgtctcccaaattatttcttaagtgttacacttgatttaccaccagtttccacattatttcacaatacaaaaactcacaaaaaattaccatactttcttcatattaatacgacaaagaatgatgaacttttcctgtaagcctgcctgccttcttcttccttcctcttttctcatctccttcctagcttctttcactcaccatctcttcttttttcccttttctttctttttttcttaggattctgtatttttacgatgcaagctctgtttgtggtgggtgtttagatgacattaaaagatctctcttttaaaatatttcctttccaacttcagcaactatggagaaaatgctgatacaatatttaaaatttaatatacgaaagttaattttctattacatactccattgcatgttatagtaatgcacttgaaatatattatctccatttcatatcaccatgccaaacttacaaaaattcagtatctttaaaataccaagactatttagaacaaatacatgatgtggtgttcataaaaacaatattggattaagagtcacaagagtcatttccttaacttggttctatcttcaacactttaaattctctggtccttagcttctttagttacaggatgagtgactgcaataaattatctctaaggtcacttatcatttcaaatgtacatcttggaatcactaaacatttccttataaaagggcaataacagaaatatttcctacagctggagtcttcttatctgccaacctcaaccattcagagcccagctctgcaggaaacacccaggttttgagcagtcaaaataaatgctgatgtccatgaaccaaactttattcacaaggaaactccttgggcccctctcacagagactgtttactctttacattgaatctcttttaaagtttgattatgttgttttcaaaggcctggcatgttagtggcaaactggaaagggactatgagacaatcacagaagggagcaataaatgggcgagtgcttcgaaggctctgaggtgctgcacaaatgcgggctgttatcattagcgagagtgactgacaactgacaggaatagtgagagaaaagataaatcattgtaaacaaagcacaggaatttcaaaatactgtttggggtggggctgtttagtatattggcaagtcggttgaaacagttcagtaattcctgaaagtctcactgaattatagcatagtatgtgcttatagaaataacagttatcaaggagatgtttatttacattctgaataatatttggtttaacagatagtgtaactggaaagtgaaatcttaagcactatataatggtattttgacatgtaattttatttgacatcagaagagtatgcaagatgctccagatgttccaaatattctccatctaaaataatttaaaaataaaaatctataaggtataagaatctagatttcaaatacctagaaaataatatctgagtgatcttgaatacataaaatattactttaattttgaaatgtagtttatttttcttatccataatggtagtaattaagatgaataatattaattcattttgttccctatttaaatgaaacagtactatgcctgaatcagaatttcctgcatgcagcatggcttctaagctcacaagcttattatgagagtagtattggaaagatataaagcatagtgcctgccaatacttaaaacatattacatgctgaggcaatgcaataaaaatgtttaataattcttaagtgatagtggcaaccaatctaaagcaaactcaagttacagttgaaaacacttatcaattgatatagagttagaaaccaaaatcaaagtttgttcaatgtcaagttactaaaatattcattgaaaactccaacagcaaattaaattataagatgaaaataagaaatctgacatactatctttttgccagtccaggcataaaagtaatagggctagaaattccaactgaaaattaactgtatgctttttctcatattggagaatctgaatcctagaatatttaagccttgtcttatatcatattatgcataaataaactgaagcccaagaaagcaaggtcacaatgaggttaagatgaaacaagaaacttgttttctctagtctctttacactagtgttctttcaagtatgagttataaaacagatattttatgtagaattttttttaaaaaattcttatcatctactacctaacattagtggcagacagcattgtaagaatgaagacctgggtggttatcagagtccatgttcttcagggcttgaggccatgcttttggaaatcatttcccagagccggggcatttgaggagagtacagaaaagcaaatgaatggtgaataggagaaaggccatcagccaggcagctgcaggttagacggatggattgacttcccagcagagcagggcacagtttgctcaattacccttttgtacagctgggaaagaaagacaggaacatcagagactgctatctctcagttaccaataacttttgaaagaggtatttgaaagacatataaatgatattttccactgcctccctgtgcagggaaagcattgtatgtcaagtcaaaactgaaattcactagtaaccaaaattaacagccatagtctttggcaactatctttggtcacactatcacctagaattggctttgtactttgtatcagagctttacatgaggtccttgatctactcatcagtgttttcagaaagacttctggattcccaaataaattcagaaacttctcttaaaaagaaaaattagtactgattaaaaagcacagtattacagaacttgttattaacattttatttttgcatttactttttccaatctcaaattggtaagcacaaagcttaagaaaacaaacaacagtatttctttaggagagtttaagttccagctttgggtttttctctttctgtagtttatagtgtgtggcaaaaagggctcgcgtgtgttaaagccaaaatgcattttgcattaacaatttgcgtttagaaatccaagcacctaacaccaccagagttaatatttgctttggactcttctacttatttagtctcaagcttttccaaagagctaacacaaaaagacagctttcctatttgcctagtgagtgtgtgatttcacacatagtgtatgatatgcttctacagagacttggtattagctgtttttcatgtgagctgtgtacttagttatgttgggaaatgtgaactttgtagttgaaaaatgcagcaaactgactgaggctcatatcgattctactttagaaatgtctcctgtctccttttcactgtgcctctttttcattcccactgccctatttcactatgagtacataacctaaacactttaacacgattaccttccccgagtcccttctccagctagtttgccttcatactgctgccataattttcaatagcaaaaatctgaccacttcactgccatccttaaaatgaaccaaaaatccttttgttgactccacattctttacagaataaagtccaaattgtttaagctattatttaaggctttcaaagtatcaccccattgcttctttcccaggtgcctttccttccatcacctcctacagcccctaaacctcagccacactggctgaacatgattatacccttgctccagcctttctcttgcaaggagtttccttcatccttctttccacttgaagaaattcttatctgtgatgattcagtataaatgtccattccaggcaaagccttctccagcctattcatcaatccctcctctgctcctgcaacatttggcatataatctccattattccaataaataaaagccaaagagacataataactttcagcactcgttgtatgaaaagcacttttttaaagcaacttatacttattaatttagtatattcatgataacactatgagcatgatactattaaaagggggaaagttcccttgtccccctcacagggcatgcgacaggggtagtggctcgcttcttcagtgccccactgctcaaacctctagggagcacacagacgggcaggttatggggcaggttatggagctccgaccctatcgcagtgtcttgtgctcttttagtttcgccgtctataggcggcttgtgttaaccagcttaattagaccttctacgttgtcacaaggacagagggctttctgtatctcgggttcttgccttggtgtaccggaagaatcagatcacgtatgggcttggagaatgagtgcaagcttttatttagtggaggtagctctcagcagatgggggaagccagaaggaggatgaagtgggaaggttttctcctggagtctggccactcagcggcctagcctctccttcagctgcccccgccaactccgcgtctgtttctgcaagcccacggcctgccggcctgctggtgcctgtcaatacatacctcttgacgtccagctgctcgtttgttccccccaccttccccccgccgatgtgctgctcctccagacgaccacctgtgtgtctctgcctgctagggtctcagggtttttgtaggcccaggatgggggcatggcaggccagggtggtcttgggaaatgcaacatttgggcaggaaaacaaaaatgcctgtcttcacctaggtgtggggacacaggcctgggggtggagccctagccagggaccacgtccccctctacccagctcttcccttcccccttctgtatcatttaaagggaccacgctcttccctacccagcacttcccttccatatcactatcattgtcctcaattttacagctgggaaacattagtgcatattggctaagtaactcactagaagtcacctagcttattagtagcagagctggattcatccttaccaggtctgaggccagaaacaatgccttaattgctacactctgctgctaattatgtttcatttctgtcttctagatttttatctccttggaagaggtagcttatttatatgtatatgttgtattagaccgtcctctcattgctataaagaactacccgagactgagtaatttataaagaaaagaggtttaattgactcagttccaccagctgtacagggaacacagctgaggaggcctcaggaaacttgcaatcgtggcggaaggtgaagaggaaccagggacatcttacatggccagagaaggaggaagagagtgatgaggaagctgccacaggcttttaaaccaccagctcttatgagaaggcactatcttgagaacaacaagggggaaatccacgcccataatccagtcacctcctaccaggcccctcttccagcattggggattataattagacatgagatttgtgcaggaacacaaatccaaatcatatcatatgcccagcaggagtatagtatctggacattttagccaatcaatagctttatgtccaatttatctgaattaatacgaatcagagccttttagattaaggaaattttatttttaaaaataaaaatattttcacagaaaaacattcttagaaaaaatattgaagactgtttggcacagatcagtaataaataacttattaaattctaatcagatgtttagcatatatcttttacagtctttggattatatcaacaatattagataaagatataacctacactattcttcagatatatttaatttttttcattttcaaaagattttattggctttcccacagaaatcattataaatattctcatagctacaaaggctttagaacaaatagaaaatttccataactttatctttctgaagtataattgtgttgaagtatgatcagcgatttttattgatcttatgtgtttaccttggtgactgttaaataagattttgtattggaaattttctttgttgaacagctccctgtttttaaaattagaaacacaaatttatggatttctacataacaaactctctaaaatgatactctttacctaagaagtatgtaatatatgcctgttaattaaacatgtactaatagttatatttgcatgttgaggcttcctgcaattcacaaaacataaagaaaatgttttaaattgattctaggggtggtgttcttattagctgttgtaaatacacagagaggtagaattgtagctgaagaacacacacttatagcatatttttgtaggactcaggtgggaatgaacttgaaaattaccattggattttcagacagtaatacaaagtatttcagtcttttccatgtggtttgtttgtttggtttccaattaattacttcctgggggaagcattgggagttgtttcagttatagattcataacaaaatgagattcataaactaaatacatgatataatctgaagccctgctaggactcttacagctcgtctttataacctagtattcctttaatgagtaggaacagtgaacttttttttaaacccaaatgacactattgtctttaaaagctgttaaaaatagcagagccaaagacgtaatattataatattcagttaggggaattttgagtgtcattatctccctaagcagtaaccatgaacaaattatcaaagccattgtctcttttaaaatggaaagatgaaccaaatgtattagcacctcagtgggattgggaatatgtgaaaaacataatcataaaacagcaattgctaagcctctactcaagacactcttgttcatcagaggttttggtgctgttggaaagtcagcacctgctgaaatctgcctggggattcagctgcctagactggaatcacctctgctaatggatgccaaagctttgcccttgaagatgtttgtgtccttccctctccctataccagtggaatttagatgagactgtctaaatgtagaatatattgcataggctgaagaaattgtgtgtatcacttgtttttaattaatagactatttttatctgttcttagtttatggaaaaatttgagtggaaagtaaagagctcctatataggcccgcaattccctgcctccccacccccttgcccctagtttcccctattattaacatctttgcattagtgtggtacatttgttgcaattggtgagccgatgttgatacattattattgactatagtccctagcttacattagattttcctgttgtgttgtacattttatgggtttcgacaaacacttaataatgtttattcattatcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttcgtgtttttttcatggcttgctggctcatttctttttattgctaaataatatttcattgtctggattaccacaattttttcattcatctgttgaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacattaaaaagcctcattagacttctggttcctgatctgaaagatgcctatcttcttgaatattcatgattttctattttattttgaaaattagaacagctgccacggacaggacttgtatttcctgggagcaagtgccaaattgctacatagcatcccattgagaaagaagtgataaaatgtgttagttcattttctttctagtccttctaacctatatgttttttaaaatatttgtctaaatatgaaaagcattttaatactttccaaaacaatattcttgaattatccacaatataaaatgaaataaggacatggaatcattttttgtatatctaatagtgatgagaattggacttgagctgagaattcattttgagctctatctccatcacatactggcttcgtgatattggcttattctcttgactttgcagggagaacagtttcctattggtaaaatgaaggataataatatttgttcatcatacaggtttctttgcttatcatacaggacttttgtgaagcccaaatgcaaaaatgtacaatgtatataaaagaatgttgcaaactataaaacaccataaaaacattcagtattattaccaattgctttaatgtatttctaggtctatttaatcttttattgtatatatttaatctatacaacatgaggttttgatatacatatgccttgtgaaatgatgactacagttaagcaaatcaacatatcactctcctcacatagttatcattttttgtgtgtgatgagagtacctgaaatccactctcttagaaaatttctactatacagtacactattattaaccacagtcatcatgctgtactttacatttctagttgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggttcctctgtgttgtcacaaatggcagggtctcctttgttgaggctgagtaatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaccttcacaccgtttttcataattgctgtaccaatttacattgccaccaagagcgtacaaggatttccttttctctacatcctcatcaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgtttactactaagttttatgaattccttacatattttggatatcaaccctttatcaggtatatggtttgcaaatattttctccctattcataggctgactttttattttgctggttgtttcctctgctgtgtagaagctttttagtttaatatagtcttacctgcgtattttaattttgttgcctgtgcttttggtgtcttatccaaaaaaattattgccaagtccaatgtcaaagagcttttcccctatgcattcttctaaaagctttaaggtttgtcttacatttaagtctttaatcaatgttaaactcattttttgtatattttttatttttaatttaactaaccccttactaaattggggtgggattttttcatcacatcagtactgaaatctttattttctggaatttcatagtctactaatgtcagtgggtcaatacggttatgatctgcctaatttcctccagatgttaggatcctctgaaaagcagatgtcaaaatggatttaacatacaaagaatgtattaggaaaaacacctatgcaagaaaaaatgaggaagaagatgggggtggtcggtgtggagaataagcataccgcagagtaaagatggtcccaagtgaaagggagaggatatgaaggttgggtggaagcgttctagactgtcatgcagtctaaggaaggttcatcagggaatcggggtatccgtgagctataatcagccctcataggagtctcttgtaaccaagaaacttgcctgtcttagtatacttgttgcattcaattattagctgggaacagctggtaaaagtgtaaccttagcacaaatctggtaatagacagaatgtggcagttgggtaagttatgttcccagcagttggagatctatgaggaacattttcatgtccactagacttcacagagacttttttccctaaataataaacaaaagtgatgaaccacttatttaataatgttttactaaggatgtgaagaggagaagcagagacaagtgagacagaatgcaaatattaccaagtgtgggaaaccatctgagagcaggcacattcccagaagaggggttcatgtcagggtttagtaacactgtcctcatgttcgagttcctgtgtaatcagtctacaggtgccattgacctgctgtaagaacttgttttccttatccagtgtttttgtttatgttttaccaccttgtttgtgatagctagtcttccaaaaattcttctgggcggtgcatttaaccatttcctaaattgcagaataaatataagacattaaaaaactacatttggcctctgggatataaaatgaagttttcaaagagttaaaatctttgggagtactggaaaatttcaaaacgggaggcaccttcagatgcagatttcatacccttagaaatgataaaactacctttcaatacagcttcctatatttctcatctctactcattgccttcctaaattatcttgttctttttcccatctttcctcccactcttcaattaagaagaatgactgtcaggaaaaatggaacacatgaaaagttattgttaaaatattaatagatgtcagtatgactctctaagttcatgcattccagagttaccccactgggctaccattgtgggcaagctacaatgagcatgactctccattctcactcagtccttgaggtgacacaccatctcttaaggcagaaagatgattttatcttcagatagcagattatactgatttcccaagtgtatgtgactatttgttttatttttaatttcctctttcctgtgcttttagtctccttcaaaaatttatcttggacaaacattccatctctcctttctcctcaaagctagaaaactagatcttatagtaagctgacttcagttcttaaagaaaggacaaaatgccatagaaagccgtaatattcttcctatgaccttaacttatattgcaacccctccagggagctgtcaattaaaagcatggaatttacacaaatctaagtctcggaaatcagccagcaagctgcaccaaatatgtggaaaaatctattaaatagctttttaacctttactacttaccatgtttgattgtacaaatctatatcctcaggagacataggcaatgctaattgtgattcatgtgaagaaaagagcaaaaaggtatttcaactgatataaacatttttcagtatgaggttagatacttaatgtggaatataccagaagctagcataccggactagatcactcaaccaattcagaagcagaaatctactactctgctcatttagtagccctaataatccacttttttatccctggtaattcactacctcaattataacacagcattttctaagtctgtaattctaatactattgaatattactttaaaagctaaagcaatacagttcatgtaagctattattaacagatgctttctgtgaaaacaatgatgatcttattggctaaaagtctttgtgatatattttttctaaagcattttgagggatattaaagcattagaaacttttggttttggagtttggtagtgttatcaaagatagctttgattttctcaaatcaagagatctttttgttgtcatgacattaaactatttgcagaaaacaaatttaataatgtcacaataactgtgagttctttctgaagacagacttcattctaaactccaaattttccattacttcagatgattcaattaagatcctttgggaagcattatgcctgcctttctgttgaaatgtttttacgaatgcagtacactcttcttcttgctaaaataggtgaattgtattcataatttcaatacaacttatgtggtaaaatgcacaggaaagtgtaatttttctccatttaagtagaactgatactctgaaatagttaaacttagattttcatgctcagaaaatgtacagagcaatagaatctaaatatattcatctgtcctttgcattacttagcctgaattaatataactaatatttcaaatataagtttctacatctccagttaagctagttcccaaatgaagtcaacaggatcagaatctagactaaattgaagaaaatttagttctttagcaagaattaaattgagaaaatgaatcaggggagaggggagcagaaggaaaatcatactttgctagttatttttattgtattgactaattatctgagtgaaggactctacttatatgagcaccttaaggactcagcctcaaatcctaattagaagtataatagtaggaaatagtcaactttcggaacttcagttaacacaaattattaattacatacatgtttttgagcaaaatatatagtataaagaaaaacatacttaaacatttctcctgtttagtcctccttactatgaaaatctactttaaaacaaaatagaggcgattgttctttttacacacaaaatctagatttttttggttcattgtattctttctgcctatcccccccaaagcacccccttcccacgcatacagagcatgaagtatttttaaatgttttttatttaagtttatcaccacttaagggcctgtgccttacttagcatgttggcatagaccccatagcctggccaaaaatactcatcatttaggaatgatgacttggtaacacaggggtttcattgtggacaagtatgtggaatctcagtctcctgctcagaaaaaagaatgtgaggatcattgccaaggaaaccctaaagcccagtgcttttagtgacatttcaaatgtaagtctagatctgtgtacttttttccatctatattatattccattaaaatgtttttaaagcaaaaatagcttttggggggacaattttaagaggggacaattttgggggaacactaatctcaaatcaccacagtgctcccctctcactaccctgtagctgtattccctaaaatttcaaagaatagtatagtagatgccttaaagttcattcctggatctcaagttaagaaatgctaatgagtgcagtagaatctgcatatattctgatttaaaattcatgaggcaactcaaaaaataaaaataaggtttcacaacttcagtcaattctgttgctttttgatcatttctaaataagatttttgcttataatttaaaaatggccccaaaaggaatccaaatgctagtgttgatgctgaaagtaaagagaaaatagagatctaacattttattgcattttattagagaaattttatgtgcgcttatgaatttgggaaaactgccagtcttaggacatgttccttatgaagatcaaagatctactctgtagaaattgttataataaaaattgagtttgcccaaagagagaaaaccaagcgtcactcagtgcttctcatgcactgtgctattgaggtagttcctatcttcccatctatagaaacctcaattcagtgatgaggtcaaatgaaatttcctccaagaagcttttaccaatatcctcaatctcattgctgggattcctttctatacagtcccacagcatttggtttaccaacccaaaacctcacactgatttcatcttgtttcttaaggaaaaggcctctgtattttacttatacattttcttcacaaagcacacctaaaacttgccctgtagcaggtgtccaataaatatttgatgcatgattgaatgattcgatgatttttgagataggccttaaaggaaacataggaatctgaacagagtagatggggccaaggaaccataaaattaggtagagatggggtaaagcctaaactaattgggagaaactgtgacgtatccagccccatagatcatttcatgcttgtagaataacaaactatcaggctaaggtaaattaagaaggtaattttctgcacagcaatgtaaatatcgatagtgtatttttaaaactttattgtttgtgtaattcttttctatgacataatatggattattatattggcttattgtttaataaaaagataaatatttagagcattaaattatatcaaacttggaagtaaaataaagagtacctatcttaaaacataatcctgggtactactagtagtttataatttagtaacatgggcattttccctctgaagattattccacagtggcaagtggtggggggaggaggaaggaataattactatttatcttatttgtaggcctcactcaattatatctacattataatgtataacacttgagaaaggcaatgcagaaaatgaattttgaataaacatatccctacttcagatgcagcagacccaaattggcctctaactacccccatttgttgaaggaaaattaacaaagaaaaagaaacgagaaaaagcccttctttctatttcacaaaatgacattagatttcatcaggtaacttctctaactcagcatcccttccaaattacttggcagttatagccctttgtatctcacacacacacacatgcacaaatgcacacacagagaacttactttatatacctcatgaccttgatgagaatcttaaactcttgtttatacaataaagtatgggagaagctgagagataagataactccatgtgattgaatcataaaatctcaggtttgaaaaaaatacctttttcactctatcagtagaactatgatattttatcagtctttgtcatttttgtaaaaagattgggaatccacttcctgaagtcaggaattaatccctcattgtgatttaatatgtttctgtgtggcaaacaaatttgataataaccagatactatcatgtatcattctgcttctatcccttagcttgtgttcagtgattatttagtcctatgctaagattctatttttccaaaaattcctttattggaaacccagtttaatcacatgtgagaaaccaatggctgaaggtttaaacaagtgattctgatttgcataaggtttggtgggcaattttgcctcccaatgggtatttgtcatgcctggagactttttggctgtcataactgggggaagagtggtgctgtcatctaatgggtagaggcaaggctactgctaaacatcctgtaatatacacagcaaagcactctcacgataaagacttatttggtccaatagtgaccaggttgagaaacaccgctataaactagtgttacaaaatatttgcattttctttagagttgtacatatcctaattcattagtgaaacaaataggagcattagcatgtctgtcaaaattagtaaaaaaatatgaaagtaatttctaaggataaacttctcatttctatctgcctcctcagggacagttcatttgttcaaataagtctctgtaaaatttttgtgaaaccggcatttagttcttataagttctgagtccattgtagttgcagttaacccttttatgacacttagcagagctagagctcaaaacttcttttacggatgatgatgctattaatgtattggttcaataaataataattaaccaggctaaattacagcatgtgaaaatagactgtctaattctcattctattttctgtattatttgatgttcttctgcttgaaatgtggtagcagattctgaattttaatctacctcaattcaaatgtctatatgtcaggaatgcaaagagaatgattcctctgaatttggcagttagttttatggaaaaaagcatttgtcaccaaaatggccaaaattacatttttattatttcaattagaaataaaatgtttacctaacttcaaaacattaccagagtctgttttcagtgcctcttttaaatcattttctatacaaaacatattactgtaactagcttatattttatcgtcacttgcctgagattctatatatcagaattacttctttaagagatttttcttttcctgtgctcaccgcattgaatttccattaatacttctatgtaacctttgtaattctattgttctttacctttggttaataaccttttatttaaaaatgcctaaataattacacactgcttctcaagtatgacacattttatatcgtattgtatgttaagacattttaatagcaacagtaataataagtcataaaatgtcttaaatttataaacacatttaatacagaaggttctagtccaatttaaagtttcttttgacctgtgcttatacacacagccataacacatacagaacacacttatacattcccacattggtttacacttgacatttagcctctttcaggaaggatgtcacaggcattctctatgtccagtagtgcccgataatctctaggctacaaaaccatgaataatttaactaacaaatattacagggagaaaattgcaagggaattctagtaagctaaactcaatttttagacttggcaattcaaagataaaaagctgtttcttctatgaaaaatgtaaacagaatcattcgagttgacaggtactttgggtctcactggcacttcatctcaaagattaagatatcactagaaattaggacgtaatttatcaccaaatcaccatggtctttgtagcgactttatccctagggggcgcgagatgttagctctcccacagatgcaagccttcagtccttctgtcagatgaacttgggagtcagtatactctcacaagaagagagaagttgattattatagcaaacttgaaaattgattctaaaataagcacgattatggcttctaacatgccatccaacttactgccactcattctgccctaggccttatgtctgtaattgttggctttttacctactgccctctgtctagtgtggtatcttatttctttgtgttcgtcctgctcttcaaagttctttcctggctgaggatttggatttggatttggagctgtcattaaaagacaccattcatgaatttccaatacttgaataaacaacttttactttacggtcatcacaagtgaagaaagggacatttcatgatatcatttgcaaattagggagcacaagtaatcaatctttaatttctctttaaagggaagggaaaatgttctctcttgtcattccatctgtgaattcctataaaatgtgtttgctgtttgtttctcctcaagacagagcttgccacccaaaatcaaaatccaagttctctacacatccaagataagatatgaatggctttagagtatgtggcagaaatgagaattctcaaaattccagtgttgtcaactgctctctgattttccaaaatgttagtttgataaccaaaatggaaagaactccagagtcattttagtaggtgcccattagatgctaggcgttgtttctggagatacaaagcttaaaaatacatgatctcttccctgttctgattgtgctttcatcatgccaatacactatgtatttgaaattcatagagctttaagactcattataaaatattatgtatatgtagcacattaaagttctatagagaagagaaaagaaaaatggtctgtgagaaagggcaaagcattaaattcttggaaaaggaattttcttatttccctttacctggcaaaggattcacttcattggtacctaagctctgtaaactgttttcactccttggccaatcatgaaaacactgttagttgccaaaggaaggtatgatttcaaataataggagacaattacaggtgcatgccctgacataaattaaggtatagagatggatcctctcaaaattattacatattcaagtgccttgttataagctgatgaaaaaacaaaatatgaaattacaaaatggtttccttggctttgcagacctctacctgtgaagtgtatgaacaagacttaatacacacagcagaaattccacatttaggagccaaatatcacagagaacaagtaatgtcatgtgcaataaagcaatttcctaaatgttattagtctgcatgtctgcagccacctgtctaaagctcctttatttttattttaacaaagttgaataaaaaaatttcttcatttacagtcttatgcttggtttgatgttaaaagggattataattgcagtatagagaacacaaaacaattttaaaattatagagataaatttttattatgagactgaacatatgataagcaatttgaagtaaacctcatgtctcaagtagtaaatgaaaatgcattctcactttgcatatttggtattctgtcttaacaatgttaaaaatgctgaaaactagttgttatgttgcatatttacatgaagtgtgtgttctttgttatgtttctgttcactggggcaaaattcttaaccttaaatgaaattttggtatacatggtgattgatagataacagtcgaaagatggtatcctcccagtcctgtttcttcagaaagtcagaagatggttttatttatgtgttgcagattgccgtcgctttgcattttagcaccacctggtggacaaaatatcatttgtttttttctctactgtttaaagtagccccttcacactctatacccgattatgatacaccttaatagacattcagctgtgtaagttctaaattttaaagattgttgtaaataaactaaggttaaaaaattgaaatgtttcccaagtactataaccaatttaaatgcctgggtttttttaaccttcataaatatatccagatttgaataatgcttttcattcatatgcaaaaattgcttctttccacattttaattttttattgtttatattttttcttaatatagaattaaataagatgaggcagttttctgtatgtacaaaattgtggtttaaattatattgtcttccaaaaattcacataatcactttgtaaatagcactttatgaagcatgttcatactataaattcttactatgctaatattttatacaaaattaaattagtattttaatttatactactacaaaataagccactttccccttataaataaaattcagttgtggtcttatgtgtattaattctcagtttttaatagttttttgaattttacagaagaaaaatttgataatattttcaaatgaaaaacacaaatatagttaaagctagttttgagaattttaatcatgttagtctttgtgtagtcccacatttctataaaatatggtggaaattatttctatgaaatacagtaaagaagataattcatctgcagattccacgatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttttcccccaaaggccttggatggtatactgtaaattcagcatatggagataccattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatattttaaaataaagccaataaacacatagttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgattttttcccatatttcttgcagatagtaaaatcaaatcttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaaaagaatttgatggtcaaatactttacaaaaagtttattgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagtttattgcatcacttctcggagtctttcatatgtaaaatgcattaagaattgtctgagggtcatagtttgattcattgcttagatttatttgaccacacaacttttttcctcagatatctccaagaacaaacattctgcagaacacactgtaagaaatgtgcttaagcttgcactcaaggggtggtttaacacagtcttttaaaatataggttctgaaatcaacaggttccacaatgtgctcactgtgagattctgggcagaggaattaatccctattttttcatccataaaatgagataaaaatatcttcctcatagtgttgttgtcagagtacccgaagaaattgatatcaaaatacttacctagtacttgtcgtgtagtaatcattcaacaaagtgaactcgtgtctgtgatgctgcagaatcctaaccatactatgctcgtgtgagtgggaaatgaaaggaaaggaaaggaaggtggtaaggcagcacagcatttctctgtagcctccttctatttagtatccagttcactcgaggtaactttgaactatttctggtttcctataaatgtggaaatgtgaagttaaggcctctgaggacagagtctattagtgccaacaaaattccaagtgcctgggagactaccacacaatgcacttgttcaatcaaatttgctgccaaaacaaatggagtcaggtgatggcaaactttgatgatcatagaaaattctaactataacccagggagtagcattcacccagggagcagcacagttagtgaaatgtgggagttagtaaacccagggagtaacacagttcagtaaactgaactggcacagtggcactggaaatcaaacaataatggcaattttcaaatttttagttcagcaaaagtcttcagcaataaactgaaatatatttgaggcactatatgctctaaagtcaatcttgatttgcagaaatcaaacaataatggcaattttcaaatttttagttaagcaaaaggcttcagcaataaactgagatacatttgaggcactatatgctctaaagtcaatcttgattgcagaaatgctaaaatagagcatttgcaatgctctaatttaatgtaaccacctaaaagacaaaggaaagttttggaaaaatgagccgaagtaaacatagagaagaaatggcctgatttctcctggatcatattgtaaactccctgtgaatggagattacagctccctattcactcctcccaaccctactcctgacacctcctcaccattatctgccatagtgcctggtgcagaagagggattgaaggctatcaagagtggtacagtgtaaccataatgaggccaagctctaagctcaaatttttgctctgctaagatttcccagccaagaccttggaaagttacttaaccaaactcaacctccatggtctagtctgtagatgaggctaatatttaagtttaacttataaggctgttatgaatattaaaaccaattactgcatagaaagcccaaagaaggccgggcacggtggctcacgcctgtaatcccagcactttgggaggccgaggcgggcggatcacgaggtcaggagatcgagactatcctggctaacagggtgaaaccccgtctctactaaaaatacaaaaaaattagccaggcgtggtggcgcgtgcctgtagtcccagctactctggagcctgaggcgggagaatggcgtgaacccgggaggcggagcttgcagtgagccgaagttgtgccactgcactccagcctgggcgacagagcgagactccgtctcaaaaaaaaaaaaaaaaaaaaaaaaaaagaaagcccaaagaaaacacctgccataaagttaagtgctcaaaaattagtaactattatttattgaataaggggatgatgaataaggtagtggtctaacatactttgcataatgaaggaatgacttaagaagaggatttgcgttgtaaacctgtgattaaaacagttaagaagaatattgttgatgtattcagatatttaagcaaataaaacttttggactccaatatcaacttagtaattgatattattaattcttaaaactgaatcctccatagaatcctaaaatttgtcatggactataacatatatcacatttaattttctcaaaggtcttgtagggtacataaaggagggactgcccctgattttacattaaattgcttattaggtgagagaatttttgtgggaccagaggaagaaatgcgttatatgtctcagtgctcttggcataattgtgtatgcagagtacatcttattttggtgatgtttttgtatgaaagacttttgagctcattgttatgactcagcaaaactatgggttgtattagttaatctgactcattccttaatggacataattattttacaagggtaaatactgtttctccatcaagactggttaaactattccatgtataaaggtcagctacatcagttttggttagaggtgtggacatttaaaataggtggattaaaataaagaatattccaaagataattgcccaaaatatccaaaccagtatttgcagctcaagtgtatacctgccgtgatggttatctgaacatcattttgtacctttgtttgcatttatttatgttttattttatattaaacatatgcagcccatgtaagtttcaaaacagttaataattctatcttctcaatgaaaaaaaaatctgattcctagagctctaccctttcatttttactcattatggcttctctcttatgaaggattttctgtaatcaaatatttacgtgagacttgtataaaaattattcttcgtagacaaaaaatatagatattggtagaatatggccaaggaaatgttattttgaatgtaatcctgaaacatctgaatatgcttgtgtttaaatgtattattattttaatttttaggaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaataaaaa

SEQ ID NO: 7 - DNA, 170779 bp, Homo sapiens
gcggccctgagagctgactctgcagctgaggtagagagacaacgatcaggaaccctaagaagaggcgccagaggagccgccttctgcctcagaacggcgtgactcggaggtgagagcgcgggcactccctccgcgaaaggcgggggacaccgagccgtcccaaccccgtcccgccccggaggaggcgccgcggaaaccgttaggctgggactgagggccggggcactctccagggctcggccccgtcgaggggcgcggaccacccccttctgtgggcgcgctgtgggcagaggtgcagaggggcagtggggccggggacaggaccggtctactagtcgggcacctgccggggccgagcctagccaggacacgcttgcgggggcgcggccgggggcgccatccagcccaagaggaggcggcatctagcccgagggaggtggcgctggtgcgcgggcggcccttctctctgtcccccgcctcctccccgcggcgagccgcgtagctccggagggctcgggggcgggggcgggggcgggggctggggcggaatcctcctgagaggatcgcccagcacccgcggcgccttcggctttggccgcccggcagccgccgaacttgaacgcttttctgaagagagttttccccgctcatcttggggttaaaacctcgaaaacccgccctctgtttgatcctgcgtggctgcttccagtacctggcagttcctctccccgggcgagttaaccacctgttcagtcgggaggtggactcgaggctgcagtcctcgcccggttttaacaacctggatcttcgaacttttgacacggctttggaaacgacgtcatgtgttaggtaaaggaaaatgaacagataatttcgctgtcagattgcgagcagaagagggactgttttaatggatgtggtcgttaattgttcttttattcaactgttagcgttacaagccttgggatattttagagggtggaatgcgatgatttgctgggggtgctagagattgtgaattcgagattttcttttgtgagattttacgtaagttcctttggacacctttgtgtctgaccatctattaaataagagtcgcaggctgatgagattttttttttctttttgcggtataatcattatgtgttcactatgggtttttaaaaccgaacaacgtaattattttgcttcttactgtggtctgtgttttttagttcttgaaaccaaagtgtgtatgcttctgtattgtaggaatgaaataacagttgaactcttactataatattttatcaccatgctgttaccagctccagtactaaacatacgccactcaggagtttgagccatatgttaggcagaaacgaattgagttttgtggttctgatcttatgtttggataaatatttagtttttgcgtatttactaactcttgtcatcttgtgtcacccacaaatgttcaagtgagttgaatcccctgtcttttggatattttcttggttgaattaatttttcttaagtaatgagatgaagtactcactgagacagatggtggcccaacagaaaacagtgatgaaggatttttaccacatcttttatgaaatataacctgaaatgttgcttttagctttgtagcctactaatcttgctttctaatcacaccagttagtgggaagaagggatgatgacaggagaaacatcttgttaaaattttaatattaaatcttatatttaaattttttagcactactacattaaattttactatattgtcttgtttcatttcatagatcatctgttagttttctatgtgtaggttaactggaaaattttttatcccaggctggctaccgttagccacctgtatgcttctgaattaactccctctttttcccttttgtctgaatcctccaaatcattgaatgctccggaaaaataaaatcctggttaacactgtcaagcatagttataagggtaattaatttatcccaaattaataataagcattaaaaaaaacattctaggattatcttcttttggtgacgtctgtgtcttcacttcctctatctgtgtgagtaattgagacctgatttattttaacacacatgtaatgattactctttactagtcacatttctacaatataatagtaagcatattttattactaatttaaaaatttctccctcttccctgaccagccagacatagctaagggctgagacatccttaaccccccgaaaaaaagagggaatgcatgattcatattctcattgtcttttgtagttttaggcaaagagcatttaatttatactttatcaatttttagtaatatttgcgctgttttaaaacatttgcattttttaagatgttcatgacatccaaggcttgtgtattttataatctgccagtatttttaaaatacaatttgatgaagtaaccaaaaacgttttttttttgaaacattgttggtgcatttttgaatgaaaatgaatctagatcgtgtctttgagaatggtgtagggatatgcacatgatttccaattttattagccagataactaagtgattagtgtttctggtttttttttgtttgcttttgttttttttgttttgtttttagcattgcctagcggacttcaaataaactcacaatattgtaattccgaaggtttagaatatggtgcatatttattccattgagccttttactgcttcagtttatcacattgcaaaacaagaaatatggctcccatatgtgtgaatgtcaaaaactacttgttaaaacgaaattagtggccattaatgttgaaaggcaaattttgtacttttacatgtattgtgagcttttataattttcttaatattttggtcttatttcagataattattcagtggtctctttttatatctttattcttacctttctgtcttcccactgttgtggttttgcttgtctttaatatatactttcaagttttctgtgtaacctgtggtcttccatcaagttcctttgtgggtgtcatctttcaatgtttccaatcacttatcacccattaccagtccttgggctattttttcctccaagattgagaactacacctgggagatgtcatgtgcttgcagggtgatgcaatgttattaaagtggggatacaaacatagtgtgatgtcttccttccttcaagtagtttacaaattagttgggggtactagactaatagtatcattagcaaaaattataatatggtattattaagttgtgtgacaccaactggaatttaaagggaagtgaagccagtgagagctagaacaatcctggaaggcatttggagggagtcagaggaaacttagaaatgatttagataacaaaaggaaaggcattccaaaagagattcacaggcagagttggaagtagtagtagaataagtagtccaagagcatccaaggacagaaattgggacgaagaaagaaagaaagttaggtcgagatgttagcttaagcaccagggcatcagaagaggaaaataggcagagctggacaagacagtttgtatcattaggaacctatcactgaaagaactatacctcagctttgacatattaatagcttaagctttatgtataatggatagcttatatgtgtttgtttgtatggcttaggtcaggggtcggccaactttttgtgtagagtgctagataattaaatattttaggttttgcaggccatttacagtctcggttgaatgttcttgtttgtttgttagttttttataatcttttaaaaacgtaaaaatttttacattgttgtctcaagagccaaacaaaaacaagccatctgtggactggatttggccaggggacctagtttgctgactgctaggtaataattggcaaagtaattgtccatatagcacatactgtgaaatttcttgcatcatcttgtctatatggtggtttgggcgttttatgactatcatgtatatatttttccttatgttatcctaaaaaaaaagtatgtagaaataagtgcttctgtaattgttattttgtggccagacttctaacaagagcctagaataggtctcagaattaggaagtgaaagacgaaaagcctttgagtcaggccttactacagtgaaaatagctacacagtggcttgatttagaatttgtataaggttaggtgtatcaactgcctgtgctggttttacatttttaaaaacagctggcaggttaaaaaccttgtctaggatgctggtggtctgtaagtgacaacagaggagcaggcagtagggatctttgtttttagaagtagtctaggatgagttaataaagggacaagcagttggacattctgcagtactccagaaagaatcactctgttatggaacagtctaataattgatatttacattgatgagcttgagtcatcaagaaaagattatatcatgtgcacattaaggcacggaagaaagacctagagatctctttacaaataattaagatttttttaagataagttatggtgatttaaaggatataagtatcagctgttttgaaaagtaatttacatgaaacatctctgaagtttctaaatttatagatatctatttctaaggcagttctgtttccttcagtatactgtggttcatgtgccattaccaggtgaatagtgatgcctcacgctgtggctgcacaaatcaattggctggggcaactgtattttttgtggcatcaagagagcaagaatacatcatgagagcattttttcattaagcaggcatcagtacattccatatatcagggttagtattaggtgctggaaaaagtacagatgtataagatgggaagcaacctggacagaatcagtgatgcttctttcttcctgttaaaaacattaaaaccaaccaaacaaaatcatgaaacttaacttttgtactttaatttattattagcatttttcatacttagtacatacagtaccgtaattttaaggcaatataaagcttttgatttaaataacagccttcataaattgctacttaatacaatttttactttttaaattttagtttaaggagaaattcatgccctccctctttttttgtgaatgcttgaaacagcttcaccatgccagctgtttccatttgctaaacaagaggtaaattaaagtaccttggatggtgactcaaaagtctagttcttagttctaacttcaccacttattacctatatgattttgggttagtttcttgcaatcttggttttctaagcattaaaatagagaataatatctatcctgttttcctcaaagatattgtgagaacccacagagatgttggaaactataaaagcattaaaatacataccataaaagtgcttacattaatgctactatattggaagcaatgcagcctttttttttttttaagaccagagttcaagctttatcctccaaagttctgtaaacatagtatgtttccagtaaacattcagttgagctcattgaattttagaacctatacttgcttatttttaaaatcctatacaaacctgccagatatgtggtggtattctcattttacagatgaactatacttctgattgacttccatatctctttctccttcacttcttgagatctcttatgtgctagttgctagaaatacaaagtgcaatgtatactttgaagtaagccttggtgtaaaagttacctaagtttggtaaattagattgtgtatgttaatcagcctctatcagaaatgctgggggaaaaaaaagtgttgtatctgttttctttcctcagaatccatattttaatatatatttgaacttttaaaaacttaaatgatttcgcttcactacttcttcagtgagggattactttaattggtttatgtatattctaaaccgacagacacataatttgggaggcaaaaaaatcttacttctctaggggttctaaacagatatttaagtacactttaaatcacagtttagacttttattagaaagtaattacgtgctttgctttatagaagtatatgccatatacagcaactacttttgttgagccataacttgaaggattagtcatttcatttactttaaaatcagtttttcttaagatttgcttaaataaaaagtgaaaattcataatttgcgattttatgtttaaattttctaaattttttttgttttcttaagacagacattctcaattatgtctttgttcttatgacttgatttttttccatgtaatattttcatttgtaatatatacctaaaaaaaatttttagcatagtaccttcatagtttatgaagtacctttttgtttctttagtaactattaggatcagcttttcctgatgcttcagattggtattcctgaaatagtatgttcgcatttttgttttaatcacttgaaccttactaaaactggcctagtgtgtgtgacagagtagcctttgggtaaaatgtaggggctactgcccctctaaccatcttttaggctgcttccaggatatttaaaaaacatgaatttattcagatcattccccagttttagaaatcgaaatcacaatacaattcctgctgcattaattataatttcctttgtctttgagagtccatactctgttgatatcctattgtgtcatcatttcttacctctttacaactttgtgatatagtgtagagaacatatttctcattaggcagccacaggattgttagttgacttctcatactggctgtatagaaacatgagtgtgctactttacctgtatgagccttggttcgttcattttacagtgtagtaataatagtagctatctcctaatatagactgtacaagaattaaaagatcctatttaacatgacaagtaaaatgcttgccataggatatttatatctagaactttgacagacatacctaatcattgtcactcaggcatcctgcatatcattcatttattcatttgcctatcatttgttgaacatttaaaatgtcctagatacttagaatatgaatgttgaatgtcacaaaaatgaatgtcacactccctcccctttagaaatttacagaatgggatgagagataatgatatgtaaataaatacatatttttaaataattaaaatatcttgtgtcttttcacttgtgtgagtccttcctgtcttttaatatttaaatgcaaaatgtttccataatacccacagaatatctgggttgtatatatcatactgtaatgtatatatattttttacttgtctaaatcagctattcaactatgaactccttgagtttgaccagtactactggagtcagcaacttttttaatataagagaaggtagtaaatattttaggcattgtggaccatatgggctcagttgcaactacttaaactgtgctacaggagcacaaaaacagccatagataaattataaacaatgggcatgactgtgttcctattaaacttcatttacgaaactaggcagcagaccagatttggcccacaggctttagtttgccaacctctgcaatggtgcatgcatatacttttatttgtgcttgacaaataaaaggcacttagtaaataatatgattaataggcattaaacactttctgtattctgggtgctattgcaaaaaactttatatgtatcagtttacttaagccttaaaacatctctctgcggtagatactattatcaccaaatgtcatagagtaataatagaagcactttcattaatagataggaacacaacattggttcaaaagtcttaggcaatacattaagaacaagaaaaataattaacctgtaaataaaggggggaaatgtatcactattatttagagttgatatgactgcttacaaatacaaataaatataatacaaatacaaatagcaaaaaaatatgagataacagaaaaagatttgtattaaaaaatttcagtaagctgattggctataagataaagttagaaaattcattagccttcttatatatcaacaataaccaactatgaaatacagtaataagaagtagcagcctaaactataaaatacttaagattttaaaatgtgtaatagctatgtgaagaaaactgcaaaaagatgtgaatggatggaggagtattcatgaatgtgtcaacttaatgccataaaaatgacagcttttactaaattattctataaagtcaatgcagttctaatcagaaattcaacaggagttttaaaatggaatttgacaaactgatggttcaagttttgagaagggagcatgcacaagaatggccaagtaaatttcaaaaagaagtataataaatgggacccatcaaaggtcgaaacattataaaattacaattattaaaataagaatttggagtaggaataggcatattgatcaaaggaatagaataataaattcaggagaagatccatagataaacatggataaagaagaattgtatgataaatgaatgagtaatggaagaactggtctataaagggtgtgggacaatcaactgtttaattgaagtaaagatagttaggtacccacttcgtgacactctcaaaactaagttccaggtggactaaatggttttttatttttatttatttatttatttttgagatggagtctcgctctgtcaccaggctggagtgcagtggcgtgatctcggctcactgcaacctccgcctcccaggttcaagcgattctcctgcctcagcctcccaagtagctgggattacaggtgcccaccaccacgcccagctaatttttgtatttttagtagagacggggtttcaccatgttgtccagatggtctcgatctcttgagcttgtgatctgctcgcctcagcctcccagagtgctgtgattacaggcgtgagccactgtgcccagccccgagtggactaaatgttgataaataaaaaataaaatgacaaaacttttaaaagttaatttaaaaactcgttggagtagagaaggccttttaagtgagacatcaaacttagatgccatttaaaaaggaaggcaagcaatagactgggataaaatattcgacatgtaatagacaaaattaatattcaaggtatataaggtgtacctacaaatcaatatgaaaaagataacctgatagaaaatgggaaagaatgtaagcaggaaatttatagaggtagaaatataggtagcctgttaagttttgaaggaatactattgaaccgaatataaatagcttcatctttttaggagaaaagtttggcagtatctatccatttcaaatgtacgttctcctgagccagaagttttatttctatatgtctgtaatatagaaatgctatcattcattaatagagagtattgcatgattattccatgcagaggagaaaatgtatgatgggaaactggaagtaataagatcatcattagaacagttaaattatggtgtgcccttacactataatattagatacttatgaaaaaacatgaaatagacatagatgtacttcttaagatattttacatgaaagggcgagatacaatataatacatacacaaagacacaattcatacacacacaaaaaaaatacaatacacaaaagcagtgtatgtgatttcacttacataacaaccaatcccagaaaacctaacacacaggtaagcacagagaaaaagactggaagggtacaccacagttgttagctatagaaataggagttggattagggatcaggaaagagttaaaaacaatgtttgtatgtgtattttcaagtataagcaagtacagcctttgtgatataacaaacataacaacacatgcaaggctttgttatgattggtcctgattaggaccattcctcctgggtggacagctttgatttatgtcggttttccctgcgtaatttttaatagcacttcctttcacttgcagaagcttcccagttggtgtctgaagtcattggtgtttttagaaatagcaatttctgtatagtgttggatctgaaactgtgttaaagtgggttaaagaagtgagaattctaccagtgattcttaacctctataactacaactgccaaccaagacaaaataaagtgctttttattttcagagtttctgttataaaaacactttgcttttttaaatataaagttataatttcgaatgtagtttttttaaagtcccatatgtctggatattttgatcctcccctttaatattaaaacctaatatttcaagacagttaatgatagaggtcaagagaggaatcagaagcttaagaggaagacagagtaaggagaaggaagttgttttttttttttttttttttttttttttgaggcggagtcttgctctgtcgcccaggctggagtgcaatggcgtgatctcggctcactgcaacctccgcctcccaggttcaagagattctcctgcctcagcctcctgagtagctgggaccagaagcacgtgccaccacacccggctaattttttgtattttttagtggaaacggggtttcaccatgttggtcagactggtctcaaactcatgacctcatgatccgcccacctcagtctcccaaagtgctgggattacaggcgtgagccactgcgcctggcccggaaggtttttttaaaaagaagttgaaggaagatgagtatgattagaggcaatctttaaccaaggcatagttgtagatttataaacaaagaatctggtcatctcagaaaggactactttaaggactactggattctgcagacaaatctacttataggaaataaagaaatgttacttgattttattatgataaaattattttggaggaattagtgaaggaaacatgttaatatggttaagttatagtaatacagtagcttttacacaggaactcaaactttctgttgtgaatttagttaccaatgtattactgtggccagaaaatattcagaaactacaggtttaatcttcagtccaaaaatcacaccaatggatttgaagttctacaagagcaaagttaacaatctataatataaaaactaaagttttatataatacttctaaaaaggacagtaaaatatttggaagtgaaaataggattgtcccaggtgtagttgccttttggctctaaagggtagcctatgtgctccaaagacactagacagctagagctatatgtggaacttaagaagatgttacttgaaagaaaaactgatctatgtgcacactatcagtcctttaatggactggggttcgtttcttggaagcagttctttctctcttgtttccatagtttcctgactggaagtatctttttgatcaagatttcctttgaagtctattttaacaggattttcatgttagtattaaggtataatttcttagtgggagaatgggggctgtatctcctaaatgtctaattaaatttaaatttagtatatctgactaagaagggtgaggatggtggcttgaatgccctcttcccttttaaacctttcttcacttaagggacatgaaagagtgaggcttatccatccgaccaacactactctttccttctttccagtggatgtgggattggagaagaataagataaataagttacagtaaatttgttgctaacaatctgtgtaaattattgatttctttgtaagtgtatgaacactttcattaggttaaattgttgatattttaaagtttttgacctcagtggcagtttcatatggtttgacctattgcattatgaaactatggctataatcactgccctgtatataaaaatgttatggcacttaaacaaaaatacattataacttatttaaatagcataaatttgtgcgtgctttggcagcacatatactaaaattggaacgatgcagagaagattagcatggcccctgtgcaaggatgacacacaaattcatgaagcgttctgtatttttcagactctaaaccaacaaagataaaaaaagacaaagaagggcattacataatagtaaagggctgaatgcaacaagaagagctaactctcataaatatgtatgtgcccaatacaggagcacccagatttataaagcaagtttttagagacctacaaagaagcttagactcccacacagtaatagtgggagacttttaacaccccactgtcagtattagatcaacgagacaggaaattaacaaggatattaaggacttgaactcagctctggatcaagtggacttaacagacatctacagaactctccaccccaaagcataaattcataaacagtacatcactgatgaaatgtcaacatccaagccaaattggaatgttcatgaatacacctactttagcaacaggtaaagccaaaaatattgttactgcagatatgtatcattatacattaaagggttaaacaaccttctccagaatctaaattgcatatgagaatgataaaagccataatatagtaatttataatttaaaagcttgtagtatggccaggtgcttggctcacacttaatagtcccaggactttgggaggctgaggtgggaggattgcttgatataaggagtttgagaccagcctgagcaacatagcaagaccttgtttttactaaataataagtaaataagtaagtaagccaggcatggtggcacatgcctgtagttccagctactttggaggctgaggtgggagaattgcttaagcccaggagcctgcagtgggccatgattgtgccactgcactccagcctgggtgagagagtgagaacttgtctcaaaaaaaaaaaaaaagataagaaaaagcttatagtaatttataagttaaagctatcagacatgaaaaccttaagtgttcagcaaagtatggataaacatatacatttaaggaaactacacagggctggagaaagagccaactaaaaagattgtatatagaacagtatccaagctcacacagggccagaagaagtgcctgtttccactagctagaacagaaagcctcataattcacaaggcattcagtagagtactctggagggttttgcattagtagtggggaaaaattaattacatattaaatgcagctctgttcttgcctaatccatcgtaaaagcaagtcccaaagagtcaaactttgtccgagtcccttagccacatgttataacaaatctccagattatttatggaaatacaaaaatatccaacagccaacaagataaagttaacagtatcttacatgcagttcaaattactgagtctgcaaagaagcaggaaaatacaaaccatattgagaaaaattaatcacttgaaattggccttcaaatgatactgatgatgatagtcattaaaacagttatgactgttggagaagctaacaaaaagattgaacatgttaaatagagatactgtctgattaaaattacgtgtcaaagacatactacattaatggcatgttagactttgtcaaagaaaagataagtgtacatgaagatacagcaatagaaactatccaaaatgaagcacagaagaaaatagaatttggagacaataactgaaaaagtatttgaagaaataatggctattttccaaaatagatataaactataaaccaataagcacaataagcataagaaagatgaataaaactctgctaaaacacatcataatcaaatcacttaaagataacttttttttttttttttgagacaaagtctcgctcttttgccaggctagagtgcagtggcacaatcttggctcactgtaaccttcgcctcccaggttcaagcgattctcctgcttcagcctcccgagtagctgggattacaggtgcatgccaccatgcccagctaatttttgtatttttagtagagatggagtttcaccatgttggccaggatggtctccatctcttgacctcgtgatccgcccaccttcgcctcccaaagtgctgggattataggcgtgaaccaccgtgcctggcccataaaggaaatcttaaaagcagccaaagaaaaacagaacaaagataagggtgacatcagatctgtcattagaagcaatgtaagctagaagacaatgaagcaatatctttaaaacatttttttgcaaaaactgtcaacctgggactttttacccaaactgtctttcaaaataaaggcaaaataaagatttcaaatatacaaaagctgaaataatttatcactttcatttatgaactaaaagacatgttaaatagagtccttcaagcagaaggaaaattaaaccacatggaaacttggccacaaggagtttagagtactggaagtggtaactatctgggcaaatatataggatttaaaaaaaattattatttgaatatctttaaaagacaaatgactgtttaatataaaaatgatgacagttgccaggtgtggtggctcgtgcctgtaatcccagcactttcggaggccaaggcaggcagattgcttcagcccaggagtttgagaccagcctgggcaacatggtgaaatcctgtctctccaaaaaaaaaaaaaaaaaaaaaaaattagccaggcatggtggtgcatgcttgtagtcacagccgctcggaaggctaagttgggaggatcgcttgaacccaggaggcggagattgcagtgagctgagatcacaccactgcattctagcctgggcaatagagaccctgccctcccctaaaaaatgacaacatgaggtttaaaacatgtaaaagtaaaatatacaataatagcaaaaatcccagagaaattgcagatttattgttgtaaggttctgatacatattcctgaagtagtgtattacttgaaggtatacagtaataagtaaaacatgtgtattgtaaattttaaagaaaccactcaagtaacaaagagttgtagcctataaatcaacaagagagaggggatggtataataggaaataattcaaaatgaagcagatgaagagggaaaaggggacaaagaacatttgaaacaaatagcaagatggtgatgtaaatccagtcgtatcaacaatcacattacatataaatggcctaaacaccacaattaaaagtcagggattgttggatacaattttttaaaattaagacccaaatatttcacatctacaagaaatccactttaagtgagttaaaaggatggaaaaagatatgccatgcttacactatccaaaagaaaactgaaatcagtaagttaaaccagaagttaggttacagaacaaagaattcttaccagagataaagaggattatttcatactagtaaagggattaattaagagggcatgcaattataaatatgcatctagtataggaactggcctgggggcagtggctcatgtttgtaatcccagctctttgggaggctgagggggttgaatcagttgagtccaggagttcgagaccagcctgggcaatgtggtgaaactacgtctctacaaaaaaatacaaaaattagctgggtgtggtggcacacgcctgtagacccagctactaggaaggctgaggtgggaggattgcttgaacctgggaggttgaggctgcagtgagctatgctcacaccactgcactccagcctgagtgacacagcaaaaccctgtctcaaaaaaaagaaaaaaggaaaaaaaaaagagagagaatgtttctgaatatatgctggaactgcaaagagaaatacagatgctctttaattcatgatgaggttatgtctcaataaacccacctggttaaaatatgtcagaaatgagtttaattcacctaacctactgaacatcgtagcttagcctagcctatcttaaatgtgctcacaacacttacattatcatatggttgatgaacaaaatcatctaacacaaagcctattttataataaagtgttgaatgtctcgtgtaatttatcgaatactgaaaagtggaaaaccgaatgcttgtatggatacttgatgtatggtttctactaaatgtgtatctcttttgctccatcataaagtccaaaaattgtaagttgaaccatcacaagttggggattgtctgtatacaaataatgcaattttagcagagatttcaatacccctctcaatggaaagtagaaagaatgtaaagcctaaaactatgaaatttcttaaaacaggagaaaatctctgtgaccttgcattaggtgatttcttaagtatagcattgaaagcaccattcataaaatgacaaatcgataaattgtactttatcataatttaaaacttcaaaagacattggtaagagaatataaaaacaagccacagactgggagaaaaatatttgtaaatcacttatctggtaaaggactgctatctagaatatataaagcactatcaaaactaaataataagaaaacagtctagtaactaaatggacaaaataatccaacaaatagtcaaccaaaaatatacctggatggcagataagcacatgaaaacaacatcattgttcatggaaatgcaaagtctccagtttacaaatggttagtaggaaaatttgagagatgacgggtaagttcattatcttgattatggtaacagtttcacaggtgtatttatgtgtcaaaatttatcaaattgtacacttttaaacatgtgcaatttgatatatgtcagttatacctcagtaaagctatttcaaaaatcaagagtagttgacacattgtattaggttggtgcgaaagtaactggtttttgccattgctttcaattaaaagtaccatttgtaccattaaaagtaatggcaaaaaccacaattacttttgcaccaaccaagtagttataacaactacttgatgcgtgtttgtttaatacatttaactcattactctgccatttcccaggagtatttgaaagtttcaactttgtttaatctacaggaaatagcaacttcaatctaaggatagtatatcatactctcctagtatattgatttgaccataatatccaaaggcaattaaaaattcttcattaaacttgattcctctacgaatactttcttatccttagatcagtatttttatctgtttctcgttgaaggataatgtattcacatctgggatgaggctttccagaatgaggtatacaccttacattgttatcaactttacatccttattatcagttagtacttaatgtaaaaacttacttagtcttagagttgtatggcccagagactagcagcatcagcctaacctgggaacttattagagatgtgatttactgggccccaccacacacctgttgagtcagaaactctgtatgtgtggcccaggaatctgttttaataatccctgcaggtcattctgatacataccaggatttgaaagctgtgatcttagagcaacaataggactttagattcttagatacttatagtagtttcatttttaaaaatctcatatgatagcacacttaagatttgtacatttctggtaaaaggaatttgacaaaaaaatttttaatgaagatgtgtacattttaccatacatgaacttttttttaaggaactaaaaattttgaatgctagtaacacatgcaaaagtgtttaggggtgaagtatactgatgtctgctgctttgaagtgcatttaaaaaagatcgctagaggaatacatgcaattaaatcctgtcaattttagaacctaggtggcaagtatatgggtgtttgctgttcagttatttcagcttttctgtgggttaaaaaaatcctcataatataaaatccttccatgactcctttttaaatttttgatcaagagagtgaaatgtgcccagaatgtgctcttaggcaaaataatggtagatagtaatgaagttttagtatcttaacagcaattatgaataaagatatagaaaactgtgtttcactagaatgatattacatttgttaatcttagaaattgactatttgagatttttctaatcaaattaaaatggaaagtgtaatcttgctaatgttctttaaattacctctattgattgtctcttcatatatccagatgaaaagatcatcagctatatatgatctagttaaagtcacttttaaggactgatataaattattgattttttcaaaaataaaaaagtagaccaatgtggtcttcagaaataaaaaaaattacttgcttttaaaacattattaaaggcttgacagtcaaatggatggtacttagattaaaagaggtttttaaagacatggcaaatagtagtgtgcacatctgatacaaatcctgattcaaacaagttttaataaaaacaagacaatgcaaaatttgaacactgactacatatttgatgatttaaggaattattgaagtgtatgtatggtaatggttttgtaattatgttttaaaaaggagttcctgtctttcagagatacatactgaaatatttgctgtggttgagcgcagtggctcacgcctgtaatgcctgcactttgggaggccgacgcgggcagatcacaaggtcaggagtttgagaccaagcctggccaacatggtgaaaccccatctctactaaaaatgcaaaaattagctgggcgtggtggcgcatgcctgtaatcccagctactccggaggctgaggcaggagaattgcttgaacctgggaagcgggggttgcagtgagccgagatgtgccactgctctccagcctgggtgacagagcaagactccatctcaaaaaaaaaaaaagaaatatttgcaaatgaagttttggaatgtcttagatgtgtttcataatactgcaagacaggaagtggggtatagatgaaactagactggtcatgagttgaagctgggtaatgagtacatggggttcattatactattatgtttacattggtgtatgtttgaagttttccacaataaaaggttttaagaaagatgtaggttaaatttaactcttacatcatgatctgagaatgaaatcatcacttattgtggtgtttcagtgagaaaatattttccaattatatctgactttaaaacaactaataataatattaataaggtctctatgttgcccaggctggtctcaaactcctggactcaggtggtcctcctgcttcagcttcttaaagtgctgagattacagtcgtgagccactgtaagagtgaaaggcctttttatttatttcttttttaatattttcagatatatctgacttctaacaaaatactgtaagggagcctatttcttgattgaggactgccttttttttttttcttttagcataacaatcttagttgtagcctttttgtgtaccaaatcttgtactgttttatacttccagtatccaaagatatgaaaaaagtgagcatggggagagaaagaaaagcaaggaactagattaagcataaatcttttgaattataaaaagctgtctttttttaaatttaatatcagtcattgaaaatgattaatagcactgtcttcttaccatcctcctcccttctcactttctctaccaatatacatttctattataaatatagaagataacaagattgcttattatgtcttcataaaatttcacattaacatatggacatttaaggtgaactgaaataatgcatgtaattatatttttaagagccatttttctgcagtacagttgacatcaaagagggtaattcaaagaattagttttggcaaaaatataaaataagctaatatcctgttcttattgttaaatacagtctatgaaatatttgtttttggtttctgataagaaatgataggatagttttgcagagtgattcccatgagtttcatctcaggaaattccaccacaggtgatttcaaataccttatttttagtctaatatagtcaagtttagaagatgaaaaatccaaacgttaaaaatgaagtagaagtctaaattggaaaagtacattttaggatatcagttcatgagataaattagtattttggataaagtccaagttgtggcagaacttatttaaattctcctgaaagggtacttagatggttgagaagccaaatatgtgtagttgcctatggctcttcaagactattaacttttaaatcaaaattttgatggtggtataaaccatatccatattataaaaaaaaacttgagaaatagaaacagttacataatctcaccatcttgatacagttgctactgtaattctaatatttttacctaacattttgttcatgtgtatgtttaaaaatactcctaaattctagagttaaatgactaaaactctttggagtacagtcagccttccatttttgggggtttcacatccatggagtcaatcaaccgtggatcaaaaatatttgggaaaaaatggattgttgcatctgtactaaatatgtacagagcttttctttttcattattccctaaacaatacagtgtcactatttacgtagcatttatattgtattaggtattataagtcatacagagatgatttaaagtatacaggagaatgtgcataggttatatgcaaatactacaacatttatataaggagcttaaggttttgtggattttggcatctttggggatcctggaatcaatcccctgtagaaaccaaggaacaactgcatatgatagtcttgtggtttcagatatggctctggagacatacagtttttagtttgaattggacacatcaaaaaaccacatcaaaacacattggatttcggcagggcatggtggctcacacctgtaatcccagcactttgggaggccttggtgggtggatcatttgaggtcagcagttcgagaccagcctgaccaacatggtgaaaccacatctctactaaaaacacaaaaaattagctgggcatggtggcaagcgcatgtaatcccagctactcgggagggtgagacaggaaaattgcttgaacccaggaggcagaggctgcagcgggcggagatcgcaccattgcactccagcttgggtaacaagagcgagactccgtctcaagaaaaaaaaaaaaaaagacattggatatctcaatctaaatgtacatatttttcctatcagtacttcagttatagtattgctgtaatccaagatgtaatcctgctttgcatttttccacatgctttttagacaaaaagagctgaagtttcaaaccccagaccaagcttattctcatgagctatctaccttagtttctaggtctaagctgttgtcatcatatagataacaaatctgggtggaattaacggatatgaataataaggttaaggaagaaaactagcagaatacatgtataaggaaacaagaacagattcagaattgtgtcagcggctgagtgagaaagcacctgatagtgttatggactgaatgtttgtatacccctcaaaattcatacattgagccctaaccaccaatgtgacagtatgtggagctggggcctttggagataatttggcttagaggagagcatgagcatggggtccccatgatcagattagtgtccttagaagaagaagagacttgagcttgcatgctctctgccttgaggacaaaaggagaaggtagccatctgagagccagaaagagggttcttaccaaaaagccaaccatgctagcaccctgatcttggacatcttggcctccgtaactgttaaaaattatgtctgttgtttaaagcaaccagactatgttattttgctgtagtagcctaagttcagtaagacggtaattggtgctaagaaatgggtgactgctataacaagtacctaaaaatgtgggagtagctttggaactgtgtaatgagtagaggctggaaaagttttgaggtgtgtgcattaaaaaaaaaaaaaatgctgagattgctgcaaccagactgctaggggcaattccagtgagggctcacagagaaaaaaggagagctggagagaaagcctccatcttcaaggaggacacataaataatcatgaacagaatgtcatttgaaaacatgggtgataggccattctgatgaggtctcagatggaaatgaggagcatgatttggacaatggagaaaaggcaatccttgtaataaagtggcaaagaatttgactgaattatgctcatgttccagtgttttctagaaggcagaacttgtgaactgttaaattgggtgtttaggtaaagagatttctaagccaagtgttgaaggagcagtttgttttctcttcactgcttattcaggttgagcatccctaaattaaaaatccgaaatataaaaagctcaaaaatctgaaactttctgagctttggcatgatgctacaagtggaaaattccatcatgtgatgggttgcagttaaaacagtcaaaactttgtctcatgcacaaaattatttaaaatactatgtaaaattaccttctggctatgtaagatgtatgtaaaacataaatgaatttcgtgtttagacttgagtttcatccctaagatatttcattatgagtaagcaaatattccaaaatctgaaaaaaatgtgaaatcttaaacacttttggtcccaagcattttggataagggatactcaacctgtagtaaaatgtaagaagagagaaatgaattgaagaaagagaaatgaattgaagcaaaaaggcaccagaacttaaagatctggaaaattctcagcatgtccatattacagaaatgagaaagaacatttggaagagaacatcaaaggggtggctggctgaccgtttgctaagaagattagcatgggtgtaaaccatggacctaatagccatctcaaccgaagccaggaatagagactgaattatattagaaacactgccagctgagattaaaggaaatagagaacatgggatagaatgaaggaagactgtgaacatgcatgatcatttcagaaaagggagaaggactccaaaggcaattcagaggtcatcagggctgctacgcccactacagatccaaagtgcatgggcccaaagggcaaggctgcttccacctcagctttaaagggcaggactgccccgcagcagagcctcatgggaaggtccctgtgagagtgctgcatggtcagggctccaccaagcggaagggacaggtcacctcactgagccatgggagtgatgctgccatttcagtatctggaaggcaggaccatcaccccagtggatatggaaagcagagcattgaatcaaagatgatgattctcaagccttaagatctaacagtatttgccttggtaggttttggacttgcttgggacatgtcacccctttctttaatctgatttctaccttttggagtgggaatgtctgtcctgtgcctgtcccacgattgtcttttgcaaatacataacatatctggtttcacaaaagctggaaaggaattttgcctcaggatgaattgtacctctaccttcacccatatctgatttagatgatacttagatgagaccttggactttagagttgatatttctgtgagttaagactttgggggctgttgggatagaatgaaaatgacatgaattttggaaggtcaggggccgaatattatagactgaatattagtgtctctccggaattcatatattgaacccctaacccccaaaatgatagtattaagaggtggagactttgggagatagttactgaaaatagttagacttagatgaggtaatgagggtggagctcccatgatgtgattagtgttcatatataagaagagtaagagacacagagcatcctctctccctcatgtgaggcaacagcaagaagatagccatctgaaagccaggaagagaggatccttaccaagaaccaaatttgccagcatctggatcttaaacttcccagcctccagaagtgtgacaaataaatgtctgttgtttcagttgcacacttttgtggttttttttaaaatagcagaccaagctaagacaatttgtaaatgttttcttccattccatagattacctctttactctgttgattgtgttttctgatgcacaaaagtttctaagtttgattaagtcccatttgtctgtttttgcctttgttatgtgtgtttttgctgtcatatccaagaaataattgccaaatctaaaatcatgaagcttttccccatgttttcttctagaagttctacagtttggttcttacatttggatctttaatccattttgagttaatttttgtatatagtgtaagataatccaaattcattattttgcatgtggctatccagtttttcatacatcatttgttgaagagactgtcctttcctcattgaatgatcttggcactctcgttgaagattatttggtcatatatgctaaagacttatttctaggctctctattctatttcactagtctgttgtcttcctttatgccagtaccacactgttttgattcctgtggctttgtaatatgctttgaaatcaggaagtgtgagtccttcaactttgttttctttcaaaattgctttgactatttgggatcccctgagatactagaattttagaatggatttttcttttcctgcaaaataagctattggtattttgatagggattgcattgaatctgcagattgctttggatagtatggacattttaacaatatgaaatctttcactttgtgaacctggggtgtttctgcatttatttgtgtttttaatttctttcagcagtgttttgtagttttcagtgtatggctttcacctccttgattaggtttattcctaagtactttattcttttggttgctattgtaaatggaatttttttatttctttttcaaattttcattgttatatatagaaacaatgaatttttatgtattgattttgtattctgcaactttgctgaattcacttattagttctaacaggttttgtgtgtttgtgtgtgtgtgtgtgtgtgtaatctttagggttttctacctataagattatattgtctgtgaacagaggtaattttatttcttcctgtccagtttagatgccttttgttgagggaagtcagggaccccgaatggagggatcagctgaagccatggcagaagaacataaattgtgaagatttcatggacatttattagttccccaaattaatacttttataatttcttacgcctgtatttactgcgatctccaaacataaattgtgaagatttcatagacacttatcacttccccaatcaatacccttgtgatttcctgtgcctgtctttaatctcttaatcccatcatctttgtaagctgaggaggatgtatgtcgcctcaggaccctgtgatgattgggttaactgcacaaattgtttgtagagcatgtctgtttgaacaatatgaaatctgggcaccttgataaaacaggataacagcaatgttcagggaacaagagagataaccttaaactctgactgccagtgagctgggcagaacagagccatatttctcttctttcaaaagcaaatgggagaaacatcactgaattctttttctcagcaaggaacatccctgagaaagagaatgcatccctgagggtaggcctctgaaatggctgctttgggggcggctgtcttttacggtcaaagctgtgggatgaaataagccccagtctcccatagagctcccaggcttattaggatgaggaaattctcacctaataaattttggtcagaccggttgtctgcttcaaaccctgtctcctgataagatgttatcaatgacagtgcgtgcccgaaacttcattagcaattttaatttcgccccagtcctgtggtcctgtgatcttgccctgcctccatttgccttgtgatatcttattaccttgtgaagcgtgtgatctctgtgacccacaccctatttgtacgctccctccccttttgaaaatcactaacaaaaacttggctggttttgcggcttgggggcatcacagaacctgcggacatgtctcccccagacacccagctttaaaatttctctcttttgtactctgtccttttatttctcagaccggctgacacttaaggaaaatagaaaagaacctacgtgactatcaggggcaggttcccccagtatcttttatttctttttcttgctcagttgccctgggtagaacttccagcactgtgttgaatagaaatagcaaaagtgagcatccttgccctttcctgatcttaaaggaaaagctttcagtcttccaccattgagtgtgatctttcctgtaggtttttcatatatagcctttattatgttgaggtatatttcttctagtattagtttattgagtttatttttattatgaaagggtgttaaatttgtcaaatgctttttctacagcaattgagaatgatcatgtggtacctttaacttttaaaaataatttttgaaggataatatacataaagaagtgcatatataatcagtatacagcttagtaaataacttaatggtaatcatcacataatagccccccaggtcaagacatagaacagtaccctaaccccaggaactgccttcatgctttgcccatgtttccatcctttcttccttgtcaaagggaaccactgtcctgactcttaacaccataaattggttttatctgtttttgaacctcctgcaaataaaattatgtagcctgtattcttttgtgtgtttttcatgcatgttgtgtttgtaagatttatccatgttgttttctgtatcactagttcattaattttcattgctgcatatagtccattgaatgaaacagccacagtttatttacaaaggacatttagggccattaacaagtaatggcttctatgagccgtcttgtatctaccaggaatctaatagctggatcataactgggtcctagaggatgcatatattcaaccttggtagataatgtcaaacttttcctaagtgatttacgaattttcatttctgttccatatgagtttgcctccataacttcattaccacttgatattgtcagtctttttcatttcattttccactttttttattttcgagacagagtctcgctctgtcacccaggctggagttcagtggcatgatctcagctcactgcaacctccacctcccaggttcaagtgattctcctgcctcagcctcccaagtagctggaattacaggcacctgccaccacactcagttaatttttgtatgtttagtagagacaaggtttcacatgttggccgtgctggtcttgatctcctgacctcaagtgatgtgcctacctcagcctcccaaagtcctagaattacaggcatgaaccactgcacccggccacatttctacttttgtggagagtatattcaagtctcttgttatttttctatctttttttaaaaatcaatttgtaggaggccagtatatattcaaaatatatgctctttgttagttgtatatgttgtaaataccttttcattttcttaaagctttttaaaagaaattacaattcttaattctagtgaaatccagtatatttttttgtttatgttttaagaaatatattttatatcctgtttaagaaatctttctctgtcccaaggttatgaagatattcttctgcattatcttttagaaccttttctttggtttaaccttgtatattcagatctgcaacctctctgacatttaaaacaacattgtttaatttgacactaattaaaatattagacctaccaaaaaaaaagttgcaagaatagtacaaagatgtccaggtttttttcacccagagtctgcaactgtttatttaatgtattttacaagcttctacatagagcactgatccaaacattaatatttcacattattgctacataaataaatgttgatatatcaacagtgatatgctggagctgtcttaacttgtgtacaaaagttggttgttaaaattcaggaatttgcaggtcaattttaaatcattggtagtttgaagtgggctgtggcagggaagaatttactccatggatgttaatacatgctgtaagttatttctattctttttaaaaatacatcaaatgttacattataaaaattaaaaataagtgtataactaaaactaagagggtatttgaggtcagaagataagactagaatgtagaaagtgagtagtaacaaaactagaagtaatttattgaaggaagaagctgacagtattctctacacaaggaaagaaaggaatgtctggtttctaaatgccagcatttgagttgcagggtaaaagttttgaatctgcaagcttaaataaaaccaattactttgcgtgtgatagatatggccatacaataaaccaatttataaatgaaactttagtgtgttctagttttaaaaatactaaaattaaagataataccttaggcaaattgaccaatgggttgaaaattttaaaaaggtaataccttaagtggaatggtaatattgaaatatagcatgtggctctatacccagtctctaatagcactagtattggaatgaacttgaagattcagaagaaaatctgtatttctatttgtaaaattaccagttcatctcctgaaaccaaactgtggttgtattttcattgttacattctaaaatttaaataataatggcggcctgcagttttagctaaacctagtacatagaatattgcaaatagaataaaatgacaaaatttaaatggctcagtggtttttattttttttaatttattaagaaaattgagttacctacaaaatcttgttaatcccaaattagcttcctggaaatgtttcttacactaactcttgtgatatgcaagtgggagaaataatacatttattctttctcataattctttgtatattccacagagcaacattatttgacaatatttaaagtacttagtggttttattggactttagtatagcaatacaggttatgccagaagttagatttgcattattttatatataaacattatgtttaaagaatatgcattttcatgagataattaaataatataaaatggctcattttacattattgtggtattaactatgaaatcttcaagtagataccaatactgaataatttttaaaacatcatagtagttgttatatagctacatgaaaaattattttcaatctaaatcaacttgtgagattcagcagtcaagattttaaataaataacatgaatttaatctcttataaaagttaaccctcttgacactactgaattgcagaatgctgtaaacattccaaaatgtttattttatttttcaatatagattcagtgtatttatgattatactcaatttgcttatcttgaaatgtaatttgctgatgttttattggttaacattgtatatgatagactaatattgcttacatcatcttttacttttctttttgtatgtgatattgtgtgtacagttaaagatttgtaaatatatgtttttttgttgaaattattgatttattgtaaataggtatcacttagaaaagagtaatacaatcaaaataagtaagtaatataagagcttgaaacttcaaacttgaaggttcttaccctaatcctgagcaaatttttttaccattgtgttttgtctgaggaatcagtgaaaaatcataatttttcttgtgtagttcctagagacagatagggtgatgagggggattgagtcttcataattaccttgtctgcccatagaaaaaaattagtgacagttgcctcactcaatcactgtatcttagtgcctatcccagtgtttagattaagtagtggtggttaaattaaataaaatattatatagagatgaaaggggtggagagacagacatagaatttaaatagagcctgctgatattcgctttaatatatcatataaacttactgactactttgacaaacaaagtaatttgaattgtaagaaatgtatttccttaaatggcttattgattggaaaaaaaagcagtcaacagagtattctagaatttcctttgacaagaatatctctttaggttaaagaatgaaacatcttgaatgtacaatgttttactgtattttaaggatatacttacaaatgactatatatgtttgtttttcagaattggagcgttattcagtatattaatgtcttattgataatggcagaacatccaccactactggatacaactcagatcttaagtagtgatatttctcttttgtctgcccctattgtaagtgcagatggaacacaacaggtaagaaaactgaaatgtttatttctttatgtctaatacacatgtatttatgcaaaatttaaaacagatcacaatagtgagttcctgttaattcgtgttttaaattcccaattcaaaatgttgttcagttttataagatgataaaaataatgagactgtttttgaagtctcttttaaaatatcttgctaattaatggtcaaatttcttatgtgtatatttagttgccattcaagttgtttttgttttcctttagacaaatagtgtgctagtccctgagtttagccttgtaccttaatgattattataaatcatttcaaatcattatgaaattatgatttttgcctacattatataataatgaaacgttgtcttttccctcccattctcttctcccttccaaaagtaaatacacaatccctgaaaagctgatagatttttttccccagcccaggtctttatttaaaatgttgtggttgcactgatttcactattcccacagtaatcctaaaaagggataggaataataagctttcacaagtacttattatgggccaggcaatgtgcttcattctcataactatcttatatggtaggtattttaacagtaggtgaggaaacaaacactaaaaacataataaatgttaatgaggaagggaaggaacagtttaggtgcccattatgtaataaacattgtgctaagagctttatgatctcatttaattctttcaacaattctatgaggtaggtacacctgcccttattttgcagatgaagcaaaatgagtttcagaaagtcttaaataacttgctcagcatcacacaaagcttgtgctcctaactgttactcatactgcctccttggaaaacttaaaaacaagaaagtcagattttcttactttataaacttagtatctatagtaggcaattatgatttgctgacaagataaagggctactattgaaaaattagtagcaattggcttgggttctaaatttttctgttctgtgtaaacatggcagaaagtgttgtgtcctggttttaattttttacgtgctcttatcccagcaatttcattccacaaacttgcttttcatggtcaaatttaagtctgttaagattttctactcacaaaaatagtagatgtggcaggtattcatttactttttgaggttgtccaagtgtcttcagttatcatttgttgcctcaggccagtcactagtttcaacttgttgataatctaatgtataaaagaatctattaagcagttaattacagtacattgatagagttgcatattctgttaaggggaagacagcaggctgaaataactccatgatgccatctcaagacttttctctccttcccccagaaggaaattgcagaattttcttgaaatcttgaaggcaccatggctatcatgtaacagtaatggtgtagatggctatagagaaaggatctgggaatagaagaacctactagcaagatttaaaggagcaggtggagttaggaggtctagggacaggtttttaggtagagtttaaaaacaaacagatttcaggaagtgtagagtaaagccttgaattctaactagcaggttgcgtgtagttcggtagggagagagctaaacacgagtggaagaaaacactggactggcctgatagatctggatttgattttggttgccgaagacaagttatttaacttctatgagtatgtttgcttctctagaaaatggaggtaataatatcttaaagtagttatagctatgtgggtgaaatgagcctgaaggaactcagtaaatgtttgccgaatcctaagtaaagcactcaataaatatttaaaagactgaagaaactttagatatcccagtcaggatttcaataaatagagatagttataataagcagtggatcagaaaacgtggagatagttatgaaggatgcatatgaagtgtaaagagtgaaccaatagctatgatagaatgtaagggactatatacaaagcagataataattagaggtgggagcgcaataaacttgacagcagacatttctttgtcttaacacaagaacttattgatacgccaagttatagcttacctatggagatatgacacaacttggttgatgcctgtttaaccacagactaaaaaactgttcctgacagatggaagtgtgcacaagcatgatgttaaaaattcaagacgacatattttgtcccttgtcttgacttttcttcagaatattatgctatatgaaatgatttctcttctactcttgggatcaaattaattttcttatagttggctattaagattatctgtctcctcattaatattttctggtttagtacagtaaacatttcctactgtatcatattacacgcagtgggtctttggcttgtgaatcataatagagggaattgctcctgatatcactgctagtgttgcctttagggaggctgtaatagtcatttattattcattttgacaagcagcttatgaacctttttttgtggttatggaatctgcctccctttttcattattaaaatagattttatttttagagcagttttaggcttataagaaaaattgagcagacagtacaaagttctcacataccacctcttctccacagtttcttcatttattagtgtgatatatttgttacaattaatgaaccagtattgatgcgttattattaagtaaggtccatagggttcactcttagtgttgtacaacagttcttcaggtcttaacagatgggtaatgtcatatatcattacagtatcatacagaataatttcaccgccctaaaaatcccgtgcttcaccttttcattcttcctttactccccccaaatccttggcaaccactgatctttttactatctctctactatagttttgtatttttaagaatgcaatacagtatgtagccctttcagactggcttctcccacttagcagtatggtgtaggtaatttctttccacggcttaatagctcatttctttttcattattgaataatacttcattgtatagatggaccagtttgtttattcattcatctgttgaaggacatcttggtcacttccagctttaggctgttataaataaagctgctttaaacattcatgtgcagatttttgagtgtacataagttttaattcacgtggataaatacctaggaacatgattgctagattgtgcggtagggctgtgtttagttttgtgagaaactaccaaactgtcttctaaggtggctgtaccattgtacattctttgtcacatgattgacttgagatatcttttcctgatagcagaaggaaagcctgcatgaatgtgtgtgccctgttagaacctccaaaccagttttatagaacataagcttcaagcaaaagtggaatgctcagttctgttctctagtgccaccatctaaagaagatttcagatgttttagtttcttgtgtggtttagcagtttactaatttgtcttctcttaatttctacttacttaccttccaaaaggattgaatacatttaaagtttcagttaagacctttaaaaacttagcctgcctattatacagtctttattagtaccttcttgattgcattaatctcttaaaattataatttttataacttcccgtctcatttgtacccatgggattttaatttacggaagtaacttaagagatggcacaaagaggctaatgccattgaaagaagatttttattacttaaatttcccaaagaaggggacgtatcatgtcatacaggtagggccaaaggagaagcagcatgttctggtcaggaggcagaagaaggcatgaggagaaagcctggaccaaaccttttgttggggttttcacaggaaaggcaaggtgaaataaatagtgttggattggctagttttaataattctgaccatctttgggctgtaagggtgatccctggtagcctggtacctggcctgggatggcttagggtagggtaaatattggcttggtgtgtaaaagttagataaggtggttggcactatagacttgggattggatggtttgcatataagaagtatgcctctggccaagccttttgttatctgtaagaattggctatccctacaaggggccatctctccccagcaagtgaggccacaggtgccagaacatcaggaatacagaaaataagaaaatagggttaatataattggccctgtgatgaatggatgccaacggacaaataaagaatctaagaaaacacagaatgtgccctcagctttttaaaacctgttttaaatcatgaagtataacatatatttatagaaaagtacgtaaaataagcatgaaatatagcatatgattataaggcataaatcttgtaactacaagccacactaagagatataatactgccaataccctagaaattgcttgtatgtttcttccacatcataacaccctctctccttcaaggttaccactatcctgacttttatgataattgcttactgacttttctctgtagttttatctatatatacttcactatacaacaatactgtagttttgccaattcttgatatttacataaattaaacttggtttaactattcttttgtgacttgctggtcttattcaatattgttttaaagattcctccttactgttgttgaaatttgttctttttagttttcagtatcagattctattatgtgtgaatataactcaatgtattcatttatctgttctcttcttgatgaccatcttgggggtttctagtttgggattattatgaagaatgctttttttctttgatttatcaaactgttaatcaaactgttaatatatattctggccaaaagttcttagtcagtcataagtgtagtgaatattctctcctgttcccctgttctggttgtcttttcactctctttgatgtctttctttttttttttgagacagggtctcgctctgtcacccaggctggagtgcagtggcgtgatctcggctcactgcaacctccgcctcccaggttcaagtgattctcctgcctcagcctcccaagtggcggagatcacaggcgtgcaccaccacaccaggctaatttttgtatttttagtagagatggggttttgccatgttggccaagctgatctcgaactcctgacctcaagtgatccacccacctcggtcccccaaagtgctgggattacatgcgtgagccaccggcggctggcatctttggtatcttttgatggacagtctttaattttaatatggtcagatttaccagttcttttcttctagagttagtgttgtgtttcttctctctctacaaaaaaatttaaaatttagctgagtgtggtagtatatgcctatagtcccagctactcaggaggctgaggtgggagaatcacttaagcccaggaggtcaaggctacagcaagtcatgattatgccactgtactctggccagggcaacagagcaagaccgtgtctcaaaaaaaatgtttaaggtatttatgaacaggaattccctatactgaggcaatgaaaatatttctaaaaatatattctaaaaactatactttcgcgttgaacattttattccaaaatctactggagttgatttttgtgaactgtatcaagcataggtccaatttgactgtttttccatgtatgtataacttaattatttcagcactgtttattgaaaaaactgttgttttcctgttgctccacaatgatacttttgtcatgtatctatgatacattgttacagatatgatcaaatatctgtcacatatttgtagggttatttatggatttttttttttgagacggagtcttgctctgtcacgcaggttggagtgcagtggcgcgatctcggcttgctgcaagctccgccatgggttcatgccattctcctgcctcagcctctcaagtagctgggactacaggcgcctgccaccatgcccggctaattttttgtatttttagtagagatggggtttcactgtgttagccaggatggtcttgatctcctgacctcgtgatctgcccgcctccacctcccaaagtgtatttatggatttttaattctctttcattgatctgttttattatccctgtgccaagaatacaccaagtcttggtatctggtaagcaaaccatcccaccttattctttgagaaggtcttggtattcttgggcctttacatttacatataaattttagaattagcttatcaatacacacacacacatgcacacacacacaacacctgctgagtttgatttagattgccttgaatctatagattgattgagggaagaattggtggcatctttacaatattgaatttttcaattgttgaagttggtgtattcatgcatttatgtaggtttttaatgtcacagtgaagttttataatttttcccataaaggtcttgattatcttttgttaaatttattcctgggcacttgggtttttatatgcaattataaatgtgtgtgtgtgtgtgtgtgtgtgtgtgtgtgtgtatcattttctgttcctggtgagttagaaatacagtttatttttgtatattgcttcaatatccagcaaccttgctatactcttactcattttgagacttgttcttagtctcaaagagagtattttcagcatattattaagcatgatgtttattatacatttttatgtatattctttctaagatctaaaagggtaagccaggtgcagtggctgacgccagtaatcccagcattttgggaggctgaggcaggcagattgcttgaacacaggagttggagaccagcctgtgcaacatatagtaagacttcatatatactaaaaataaaattagccaggtgtggtggcacacacctgtagtaccagctactcaggaggctgagatgggaggatcacttgagcctggggggttgagtctgcaataagctgtgattatgcaactgtgttccagtctgggcaacagagtgagacccagtctcatattttcaacatttctaagataatgatatatttttccttcaaattttgatgtcataatttacattaattttattattatactttaagttttagggtacatgtgcacaatgtgcaggttagttacatatgtatacatgtacatgtgtatacatatgtacacgtgtatacatgtatatacatgtacatgcgtatacatatgtacacgtgtatacatgtatatacgtgtacatgtgtatacatatgtacacgtgtatacatgtacatgtgtatgcaagtatagatgtacacgtgtatacatgtgtacacgtgtatacatgtatacatgtacatgtgtatacatgtatacatgtacatatgtgccatgctggtgcgctgcacccactaactcgtcatctatcattaggtatatctcccaatgctatccctcccccctccccccaccccacaacagtccccagagtgtgatgttccccttcctgtgtccatgtgttctctttgttcaattcccacctatgagtgagaatatgtggtgtttggttttttgttcttgcagtagtttactgagaatgatgatttccaatttcatccatgtccccacaaaggacatgaactcatcattttttatagctgcatagtattccatggtgtatatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttctacttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttcattagatcccatttctcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtggccttgtagtatagtttgaagtcaggtagcgtgatgcctccagctttgttcttttggcttaggattgacttggcgatgcggtctctttttaggttccatatgaactttaaagtagttttttccaattctgtgaagaaagtcattggtagcttgatggggatggcattgaatctgtaaattaccttgggcagtatggccattttcacgatactgattcttcctacccattagcatggaatgttcttccatttgtttgtatcctcttttatctccttgagcaatggtttgtagttctccttgaagaggtccttcacatcccttgtaagttggattcctaggtattttattctctttgaagcaatagtgaatgggagttcactcatgatttggctctctgtttgtctgttgttggtgtataaggatgcttgtgatttttgtacattgattttgtatcctgagactttgctgaagttgcttatcagcttaagaagattttgggctgagacagtggggttttctcgatatacaatcatgtcgtctgcaaacggggacaatttgacttcctcttttcctaattgaataccctttatttccttctcctgcctaattgccctggccagaacttccaacactatgttgaataggagtggtgagagaggagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggacattggtctaaaattctctttttttgttgtgtctctgcctggctttggtatcaggatgatgctggcctcataagatgagttagggaggattccctctttttctgttgattggaatagtttcagaaggaatggtaccagttcctccttctatctctggtagaattcagctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatctggtgatatcccctttatcattttttattgtatctatttgattcttctctctttttttctttattagtcttgctagtggtctatcaatcttgttgatcctttcaaaaaaccagctcctggattcattaattttttgaagggttttgtgtgtctctatttccttcagttctgctctgattttagttatttcttgccttctgctagcttttgaatgtgtttgctcttgcttttctaattcttttaattgtgatgttagggtgtcaattttggatctttcctgcttcctcttgtgggcatttagtgctataaatttccctctacacactgctttgaatgcgtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatgtctgttcttttacatttgctgaggagagctttacttccaagtatgtggtcaattttggaataggtgtggtgtggtgctgaaaaaaatgtatattctgttgatttggggtggagagttctgcagatgtctattaggtctgcttggtgcagagctgagttcaattcctgggtatccttgctgactttctgtctcgttgatctgtctaatgttgacagtggggtgttaaagtctcccattattaatgtgtgggagtctaagtctctttgtaggtcactcaggacttgctttatgagtcttggtgctcctgtattgagtgcacatatatttaggatagttagctcttcttgttgaattgatccctttaccattatgtaatggccttctttgtctcttttgatctttgttggtttaaagtcgttttattagatactaggattgcaacccctgcctttttttgttttccatttgcttggtagatcttcctccatccttttattttgagcctatgtgtgtctctgcacatgagatgggtttcctgaatacagcacactgatgggtcctgactttttatcaaatttgccagtctgtgtcttttagttggagcatttagtccatttacatttaaagttaatattgttatgtgtgaatttgatcctgtcattatgatgttagctggttattttgctcattagttcatgcagtttcttcctattctcgatggtctttacattttggcatgattttgcagcagctggtcctggttgttcctttccatgtttagcgcttccttcaggagctcttttagggcaggcctggtggtgacaaaatctctcagcatttgcttgtctgtaaagtattttatttctccttcacttacgaagcttagtttggctggatatgaaattctgggttgaaaattcttttctttaagaatgttggatattggcccctactctcttctggcttgtagagtttctgccgagagatccgctggtagtctgatgggcttccctttttgggtaacccgacccttctctctggctgcccttaacattttttccttcatttcaactttggtgaatctgacaattatgtgtcttggagttgctcttctcgaggagtatctttgtggcgttctctgtatttcctgaatctgaacgttggcctgtcttgctagattggggaagttctcctggataatatcctgcagagtgttttccaacttggttctattctccccgtcactttcaggtacaccaatcagacgtagatttggtcttttcacatagtcgcatatttcttggaggctttattcgtttctttttattcttttttctctaaacttcccttctcgcttcatttcattcacttcatcttccatcgctgataccctttcttccagttgatcgcatcggctcctgaggcttctgcattcttcacgtagttctcgagcgttggttttcagctccatcagctcctttaagcacttctctgtattggttattctagttatacattattctaaacttttttcaaagttttcaacttctttgcctttggtttgaatttcctcccgtagctcggaataatttgatcgtctgaagccttcttctctcagctcgtcaaagtcattctctgtccagctttgttcccttgctggtgaggaactgcattcctttggaggaggagaggtgctctgctttttagagtttccagtttttctgctctgttctttccccatctttgtggttttatctacttttggtctttgatgatggtgatgtacagatgggtttttggtgtggatgtcctttctgtttgttagttttccttctaacagacaggaccctcagctgcaggtctgttggagtacccggccgtgtgaggtgtcagtctgcccctgctgggggtgcctcccagttgggctgcttggggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagcggcaggcaggcctcctggagctgtggtgggctccacccagttcgagcttctgggctgctttgtttacctgagcaagcctgggcaatggcgggcgcccctcccccagcctcgctgctgccttgcagtttgatctcagactgctgtgctagcaatcagcgagactccgtgggcgtaggaccctctgagctaggtgcgggatataatcttctggtgcgccgttttttaagcccgtcggaaaagcgcagtaggcgggtgggagtgacccaattttccaggtgccgtctgtcacccctttctttgactaggaaagggaactccctgaccccttgtgcttccggagtgaggcaatgcctcgccctgcttcggctcacgcagggtgcgcgcacccactgacctgcgcccactgtctggcactccctagtgagatgaacccggtacctcagatggaaatgcagaaatcacccatcttctgcgtcgctctctctgggagctgtagaccggagctgttcctattcggccatcttggctcctcccctacattaatttttcaatgtttaactgacagtatatttctggctaaacccaatttcattgtgatacattgttcttttaatgtattgctggattggggtatgctaatattttttcttggattttatttttagtctgtgttcatgagtgagactgtcctataatgggcatttccctaatatcctgagttggtatcaaagatgtgctgaactaaactgtggagtttacccttttgtttcttattctttggttaaatttgtgtttgtttaaaattgtttcttcctcatttggtataacttgttcagtgaaatcttctgaacctaagtttctttgactgaagtatagaaatgaagaagcaaatcagatgcatactgtgaatacttcatcttaagtttggaagtacatttttataatactgaggtaatctgtgtatatttgttatgtaagtggtattaaaatggttaagaaaagttgagtttttaaataaatttaataagaactatttaagcacttatgatcaggcatttgaggcatttaaaataaaatttattgatgttattaatgcagattaaaatgtttaaggagagtgaagctagggaaggaaaatattgtaatatcagattaaaaaaacctgaattaaggtcatgttaatgatacacgatttgagaaatattaaggaggtaaaattggtgaacaagtcatagaacaaaactaagagaggggataaaaatttccccaggattttctttgaaaatgtaagtggatagcaagaccatttactaagtagttaagtcttatcagtcagaataggcaagattattttgtggtaacaaacagcttcttaatctctgtagtttaccaaaaggtttattgctcatactgcacgtccttcacaggtttgctgtggctgtgcgccacatagtcttcacctgagacccagcccctaaatagaatgttgctggtatcctggtgaactacttgctgatctccattccattttatggaccaacacaaggcacatggccaaacttgccatcagtgttggggggttataatagcagctactgtttgagcccttaccctgtgttcagacactgaggcaagtaatgcattatttcatttaatcttcataacagttcttagaagtagctttaatatttccattttatagaaactaagaatcagaaaggtgttaacttgttactaggttaagtaacatagcttctgaaaggcaaaaaccaggattcaaagctaagtctttaaaattcctaatcatttatcatggtcttaatcactataaaaatagtaaattaatggattaaatttcaggaaaaagatctgattcgaaccagagatgtagaaattatcagaatagtcagggtagtgaagccataggaattaatgagtttattcatactgagagaatttcaatttgatatgggaaaaaaatgttagtaatttctgatataacaccctagtgagtaggcctatgtaactggtattaaaatgattaatatatactgccaaaatgaaagtaggtttatataatactacaccttaacttgaacacactagagcttttcaaagcccctatatgaacatcttattctgcagcttttcctgtccaagtttttggttagcttcttgttttccctattgttatcctcaccacaagccaactgtgatgttaaaccaactgccactgattgttttacacatgctccccagggggaaagctatttgcaataagggagctctgagttaggacaaatcaagacaagccctgggactgggtgtttccagggaactgccagacaggtcaaatatgacagttcttttggagatgagacttttacggtattccaaaccattctttcccttccagtggctgctagtctgctggtttttactgctgctgtgattctgagacttttccaaggcttttgtgaagctggggagacagagtagggaatagagcaaattaaaatgacacaaagctcactgtccatatcaggatctagctgttttccctgaacatactgttgcaagcctttggttaatttctagagttccaaaaaaaattagttttgacgatttacgcctgtgttctcactgctgttatggagcaatggatttttggaggttaacactgtgtcattcctaatgatatcttccaaaatggagtttttatggaataaaaatgcagtatgatcagagtagggccagttctctatgtaatacaacattttttctagtgtcattttatatttttatattgatatctaaactttggaaaacagtgtttattatttaccaacatgtacaatgaataaatttcttcatcatatgactgtatatatagaataaaactatgttcaaagcctgctgggtgaacaattgtaaaaaggtatttttttcatctgactcagacccttacttcagaaatttacaatgaataaaccatttcacaggtcagtaagtttccttacttgagggccctcatcatttttgttgatacatgttaagctttcatgcatagcaggcctttggttagacccttcatcgagaattgtctcaaaaacattcagagcattttgtccagaggaaactaaagacaaaccagaaaaagcagagctaggtagtagagtaaaggtgcttccccctttttacattacctaaaacaaacctaaaaacaaagctctacatgtttgtttctgagattagcttttacataatgttactttgggttaaacttttatctccatggaagttgtgtttggtttaaatggaaataagaaggaaaactttcaccaatagccaaaaatctaatgtaaaaactttaaaaagtgctcacatttttaagttcaaaaagttacaaatttgtaaatatatgcatttaaaaatctgatagcttccatgctaagctataaacataaaccttaggaatgaggctactgagactgaaataaagcttatacttttgtgacaataattttgtgcctcagaattctaatacaaaccattaatcatagatttcatggcccaaattagtcatcttctaactgctatgcagctttgcctggcaaataaatagtggtttgctaaatttctcattcttagaagctttggaaaggctagaatttaaacattactctcctttttcaattagtttttttctcccacacgtctgcaccatgccactttctgtgacatttccttagaaaatcaaatatttttgaaaaattctagtgctattaccgttaacttttctttagacataaaaagccttatgctcaaggttcagatctgaaaatttgcttagttatcacatttttgtaagcacacattttaaaaaatttatgataaatattaagctaggttgtcctggaaaaaaattaacttcacacatattcaggttctgtctgtgtataaaatattgcactggttcttgttttaagagatgataaaatcagatttacaaattgggtgtaaattttaagatagtctaaagggaagaaaggttcataaaatatcagtcaggaacagagttacaaagaatgcagactggaatttagtttttatatttggcacaaaataataaaattgtattcttattgaatgacttgagaccaataccatttcatctgttcattttttaaactatatatatttccaataaaacaaaaattgggcaaattattttatttagttgaaaaattatttcattttaaaagtggacagtaaaatactttcatgtaattcaagctaatatgacaaaactaaaatattttgtagcgtttttatactatcttaatatatatttttatatatttaatatgtttttaaaactgttatgaaagagaatcatcaaactcttaaaataaacatcttacagaaatgaaacataatggtcctggaattttgagggattcttggtctaaaaagaattgatgttctattaaactcctacatattctacagttaaattccaaactctgattcagagtgactcaaaagttagtcaactcctgtgccccagaatcctgtagaaattgttaacttttaagtaatatagtttggactaaagcaaggaggaaataaagaatgacttgaaagtagcactgtataaatagggaaatgcattcaactaaaaaacaaagatgtttcccacttttgcaagtgtccttacattagattaatataaagcaagatgatttttgtcaaaaagtgtacagatagttgttgaagtagaaattgagttctgctttttcaactcataacgttctcctttcatataaaaataaaaaagattacaaaaccaaaagtgagtttcttgaaaagattaacaaaattgactagccattagctaggctaagaagaaaaagagataaataaataaatcaaaaatttaaaaggagacatcacaacggataccacagaaatacaaaggattattagagactactatgaacaactatatgtcaataaatttgaaaaactagaggaaatcgataaattactggacacattcaaccaaccaaaattggaacaagaagaagtagaaaacctaaacggaccaataacaagtaatgagattgaatttttaataatgtctcccaagaaagaaaagtccaggaccagatggcctcactgctgaattctatggaacctttaaagaataattaataccagttttcctcaaattattccaaaaagttaaagcagaaagaactgttcctaaccatttccatgaggcaaacataaccctgataccgaaactgtacaaggacacaacagaaaaagaaagctaaagaccaatatccctgatggacatagacacaaaaatcctcaacaaaatactatgtaacaaactgaatccaacaattcatcaaaaagataatacaccatgatcaagtgagatttatcacaggaatgtaagaattgttcaacatacgtaaatcagtaagtgtgatacatgacatcaacataatgaaggacaagaaccataaaacctctcactagatgaagaaaaagtatttgataaattcagcatcccttcatgattttaaaaaaaaaccctcaataaattaggtacagaaggaaagtacctcaatgcaataaaggccatatatgacaaacccacaactaatatcatgctgaatggggaaaagccgaaagctttttctctaggaactgaaaaataattggttttaatgagtcccaaattagccaacccacttatactgttgtttttcctttcaataatcatttttaagtagtagtagttcatattttgcctatttttctctctgcttctaaaagtgattagaaaaaaatattttgttgctactactgttattttcttcagtgtcttaaattatctcctaaatagcttttttgtgcttgctccacatagatagatagaggaatcatggctgtaggacaaaccgtaaatcattagatttaaaataggttagttttcaaatactgcttttttggaattgaaatacaattccatttcataagtatttactaaggtaactactactagatataatttatgttcctgaggatttataatttagcacatgagtgtgcctgtgcacactggtttataacattataaaccaatatatggcagtttgaacaaaagtgatttagatagcttttctcatcactattgacttggtaatacttgatatacttgaaaaatgtatattctaatattttcttttttcaagatttcagcatgactctgagtaatctattacattctaaagtaattctttagaatgtctgaataaaatacctgttctttaactagtaagcatagtaagcattaatttcagtgtcttatatgtgtcctcaaacatgttattgaccacttaatagcctatatacctatataatacagaaactggcatttacagctaaaacagctggtaaacttaactgatacactaatgagtgctaattgtataaggaaagaatttaacattagtcataaagttggccacaaagggcctgtatgtgaaataccctatcttgaggtgattaattggacttattaaaagtttgggggaagaaaggagattggagttatgttctaaagaaaaaaaaatgcaaattaaaaccttaatgagattgtagatgttaaggaacctgacagtatagtaaggcttgtggagcaataggatccatcagatactgctggcacagtcaatttggagagtgataatagcagtatttaataaagctgaaaaaatgtatcttccaaatccaacacatatatacttctaaatatttctcttacagaaaatcttatatataaggcacacatgtgcaaaactattctctgcattttgtaataatgatagaactggaaacagtataaatgtttactagtagggaaatggagaagatttgagaggatttatgtaatggaatactagaatactatataccagtattttattgtgtgaatctatactatggataaatctcaaaaatacagtattgagtaaaatagcaggttagggatttgtaagatgtgaagtcactgatataaatgaataaaaataaaaatttcacaaaatagcagtgtatactaataatggatgtatataagcatgcgtatgaagaatactaaatgagaatgatacactccaagttcggaaaaatgatctgtaataaaattatatttctttttcaaaagagcatctgaggaaaattcatcaacaaattctagttgattctggaaagtaaaggatacaatactgtctacttttctgtatgtttaaaatatgataaaaatattaaagacatgccattaggcattacagacagggtagttgctaagaggttttgtttcattttgttttgttttattgtttttttaagacagggtcctgttctgtcacccaggccagagtgcagtggtgtgatcatggctcactgcagcctcagtctcctgggcttaagtgatcctcctgcctcagcctcctgagtagctagaactacaggcatatgccaccacacccagctaattctgttatttttttatagagacagagtctcactatgttgcccaggctggtcttgaactcctgggctcaagtgatcttcctgcctcgatagaaggttttgagtgttatattctaagttttagatttgaggtaataagatataagtagccaataaagtttctaaagtagatcaatgaaaagatgagaataatccttgaggaaaattatttggttaactatatagttaaatgcaatggagtggggagacagcagaggaaggattgattggcttatatatccaccccaccaagcataaagtccagaggataccaactgtgaaatagaaagtaaagggggaaacctgatagttttttttttagagaaagaatgagtatgatgaaattttggaaattcaaaactgaaagagtgtacagaaaaaaacagtccaattcacatttttacagatggacaaactaaaggctcatagttagccagttgacacactgagtggcagatttgagactagactcaatatcttctgatcccccagtctcagtcactttggagtaagaaaggacgttgagtttaaactcaaaattctacaacccttggttctaggtaagtaatgatctagttgatactaataaaacagttagaaatggcagcaccaaaccgataggaatggttagtgaatgcttttccaacgctgtctccttacattcagtaggaatgttcacaagacagttgagtagatacgaagaaataaagaggaccagtaaacataaccaggtaaatacagtataaatgtattaaaaaatttttttctgtctgatttaaaagtgatttgcagaaagcaataattatacactgttggttggcttataaggtataaaaatgtaattagtgttatagcacagaggataggagagggaactgaggttagaaaagcagtgttttttacatacaattggaattaattggatcaacattattatgagttaagaggttaattataatccccagggcatctactaagaaaaaataactcaaaagaatattgtaaaagaaacaacaggagaattaaaatagaacatcagaacatatttaacataaaaaaggcaaaaatggaggaattgaggaacaaaaaagatataatatcatgcataaaacagagcaaaatagcaaactgataaggcaaatcctaccttatcattaagtgcattgcatctaaatggatcaaacataacagtgaaaagatagttattgaccaaatggataaaaattcaggtgcaatggctcacacttgtaatcccagcactttggaaggccaagattggtgaatcacctgaggtcaggagtttgagaccagcctgactaacatggcgaaatcctgtgtctactaaaaatacaaaaattagccaggtgtctggtgtcacccacctgtagtcccagctactcaggaggctgaggcaggagaatcgcttgaaccccggaggcagaggttgcagtgtgctgagattgcgccactgtactctagcctgggcaacagagtgagactctgtcttaaaaaaaaaaaaattcatgatttaactatgtgcactctataagagacactctttattttttaagagacagggtcttgctctatcaccaggctgaagtgcagtggtgccattgtagccctgagctcaagtgattctcctacctcagcctcctaagtagctgggactccaggtgcatccagttacacccagctaattttttaatttcttgtagaaaccgaatctcgcttgttgcccaggctggtctcaaactcctgacttcaagtgatcctccaacctcatcttcccaaagtgctagattacagacatgagccacactgtgcccagcccaggacactcttgaaatcaaagacacaaataggttgaaatgtaaaagatagaataagagaacttgtaacccaaagagaaatgaaatgactatactaataattgactttaagtcagaaaagttactagagacaaagaaggatgttttataatgataaaagggtaaatctgcctctaaccatcaagctgccaaatatctgaaataatgattgacagaattgatgggagaaatagacaattgaacaataatagttggagccttcaataggtagaatattaacagggaaatggaaggtatgaacgacactgtaaacctgatagacatctgtagaacattccacccaacaacagcagcatgtataatattttcaagtatacatggatcattgtccattatagggtatatactaggtcataaaactagcaagcttcaatagtaagaatttttttcttgagacaaggttttactttgtcacccaggctggagtgcagtgacataatcatggcccactgcagcctttgcctcctgagctcaagtggtcctcccaccttaacctcccaaatagctaggaccacagatgtgcaccaccatgccaggctgaagtttttttttagtagagacagggtctccctctgttgcccaggcttcagtaaatttaaagagatagaaataatacaaagtattttcttcaaacacaatgaaatgaaattagaaatcaataacagagaaatttgggaaaataacaaatatgtataaattaaagagtatatttctacaaagccagtaggccaaagaataaatcacaaaggaaattagaaaatactttggtatgaacgaaaaccatgatacaacatactaaaatttatgaaatactgctgaagtaatggttaaaggaatacgtatacccttaaaagcctgtgtttaaaaagaaagctctcaaatcaattatctaaccttttactttaaaaagctataaaaagaagataaaactaaacccagagctggcagaagaaaacagtaaagcttagagtagaaataaatgaaataaagaacagaaaaatatagaaaatcaaaaataccaaaagttggctctttgaaaagatcaacaaaattgccaacccttttaagtagacaagaaagaatgaattgttggtggtgcagtggtgagcatagctgcttttcaagaacaaaaaagactcaaatgactaaaatcaagaatgatcaagaatgagagagtagacattactacagatcttacagaaatgaaaggattattaatgagtactgtgaacagttgcatgccaacaaatagtctaagtgaactagacaaatatctagaaagacacaaaacaaccaaaaccgaatcaagaaaaaaatataaaatctgaatacacgtataacaagtaaagagattaaattggtaccacaaagaaaaactgtcaccaaggtaaagtccagacccagatggcttttttggtgaattccaccaaatgtttaagggagaattaacaccaaatctaaaactaaaccagacagagacattgcaagaaaaccacagaccaatatcccttatgaatatagatataaaatcctcaacaaagtactagcaaatcaagtccatgaacatatacaattctattttacttcattatgtacatcaactaagtggggtttgtagtaggaatgttgaagttggttcaacatacatagaacaatcattgtaatataccacatggtcatctcagtagactcaaaagaagcatttgacaaaattcaacacttttcatgataaaaacactcagtatacaagcaatagaagggaacgtcctcaacctcataaaaggcatctgcaaaaaaaacacaattaacattgtatggaatggtgaaaaacagtatgcttttcctctaagatgagaaacaagatatggatgtcctgctgtcaccacttctattcaacgttgtactggaagtcctagcctgggcaaataagtaactaaaggaattaaaggcctccaggttggaaaaggaataaaactctattcaaagagaacatgatcttgtaaaaagaaaatcttaaagaatccactgaaaaactattggaactaataaacaagttcagcaaggttgtgggatataggttcaatatagaacaataaattgtatttctatatacgggcaatgaacaatctgaaaatgaaattaagaaaactttttacaacagaataaaaaagaataaaatacttaggaatgtttaatgaaagaaatataagatgtatacactgaaaaccataaaactcactgaaagaaattaaggaagacttaaacaagtggaaaagcatctgatgatcatagatcagaagacttaatattgttaaggtgaaatactgccaaattatacatatccaatacgttgcctcccaaattcccagcttacttctttgtagctattaacaagttgagcctaaaatttgtatggaaatgcaagaaacacagaatagccaaaataattttgaaaaagagcacagtgggagaattcagtgtttctccattttaaaacttactgcagactgggtgcaatggctcatgcctgtaatcttagcactttgggaggctgaagtgagcagatcacttgaggtcagaagtttgagaccagcctggccaagatggtgaaactccatctctactaaaaatacaaaaattagcatggtggtgtgcacctgtaattccagctactcgggaggctgaggcaggagaatcgcttgaacccgggaagcagaggttgcagtgagccgagatctcaccactgcatgatcagcctgagcaatggagtgagactccatctcaaataaataaataaaacttactgcaaagctacagtaataagacagtgtggtactggcctaagaatggaatagaattgagggtcctgaaataaactctttacatttatggtcatttggttttgacaaaggtgcctagatgattctgctgggaaagaatggtcatttcaacaaatggtgctgaaacaactagatatccacatgtaaaagtatgaaataggacctatacttcataccatctacaaaactaactcaaaaatcaattaaaatcctaaaataagagctaaattgtaagaccgttagaacaaaaaggcataaatctccgtgatcttgaattatggaattatttcctagataaaaaactaaaaagcacaagtaggagaagaaaaatgagatacagtatacttcatcaaaattgaataattttgtgttgtaagttttgtgttactatcaggaaacaaaaatccacaaaattggaggaaaaaatccataaaattggagaaaatatctgcaaactgtatctgataaggggcttgtattcagaatgtgtgaagaactcttacttcttctaaaaagacaacctaataaaaaggtgggcaaaagatttgaaaagtcatttcttcaaagaagttatgtacatgtactataagcatatgaaagattcacaacatcatcagtcatcagggaaatgcaaatcaaaaccacaatgagatactgcttcacacccattataatgggtagaattaaaaagataaaaacaagtgttagcaacgatatggaaaaattggaaccctcatacactgctggtgggaatgtaaactggtaaatgtactttgggaaatagcctggcagttcctaagacagttaaacatagtgttaccctatgacccagtaatttcactcctaggtatatatccaagagaaacaaaaacatatgtccatgtaaaaaaatgaacagcattatttatattagccaaaaagtggaaacactccaaatgtccatcaacagagaaatggataaacaaaatatggtatatcagtaaaatggaatattattatttggctgtaaactggaatgaagcacttcagtatatgccgcaatgtggatgaacctcaaaaacattatgctaagtgaaagaagccagtcttaaaagtctacagactggctaacagggtgaaaccccatctctactaaaaatacaaaaaattagccgggtgtggtggagggcgcctgtggtcccagctactcgggaggctgaggcaggagaatggcgtgaacccgggaggcggagcttgcagtgagccgagaccgcgccactgcactccagcctgggcgacagagcgagactccgtctcaaaaaaaaaaaagtctatggaaatttctttttgaggtgataagaatgttctaaaatttactgtggtagtgattgtacagttctctgtgtatactaaaaaccatgaaattataactctttacagggtaaattttattgcatatagattatatcaataaaaatatttttaaagcctatttgcattttaaatatatgtttatataatttaaatgtgattaacaatccagaaataagttattattataagactaagtattatcaatctttctttgataaatgggttaaatttgtggagtcagttttagaattaaagcattaataggttatttctaggtgtatgggatttgtacactgatgcttgtttcttttatatatacatatatataaaccgcaaatatactgacatattccaagatgagagcaaaaacaaaataactaaaaatgtggctttaaaataaaatatatttgtaaacagcatactcttaaattctgacttgttaactgatactggattatctagaagcagatgctactgcacttctttgttgatttggttgctatggtgatatagtcatgtacaacagtaagcctaccgtacattggataatttgatagaaaacgaggtttgaggtaggtattgatgagtgtactggtaatcagttgtacctttaacatcctgtctctacgtgtattttcactggataagtataaaatgacataagatgccaccagaatagagtttgtaaagggtgacttggtagactaaggacaatatgaggtccaacttgccagtgaaaattaccttagtattcagtgaattgaaacaaattagaatagattgctggagaagaagctgttgaatcttacagcagctgttggtacctgtggaagcagcagttgaatgaaaaaaaatcagagaatgcaaccaacagtaagtaaagtgggttttagaagtggctttactagataagcaagtttatgatttaatacatcagtcatattttataatttatacttaaattttttgtatttattggtcaaggagtaagatcatgttactgttttttaatgtaggtgctgatagagtattaagagctacagatttaccagttttagagtaaacttaaaactattaaccttttaccatagaataattttattaaatcaatagttatagattagttttgaaaaaatactgtgatttaaatgaaaaattgtaaaaaccactttgtagttaaaactgttaggaaactattactttaaatatgtaaattatttataaatgaagttattttagcttataacttatatttattgctaaaataattatattttagcatattaccatgaaggtaaaatatgcggagtctttaaaatgctgtttttctagtatatttagagtttttataatttgaatatagaatttcagagtttatgaatctattaagaatgatcagtccagctgcactctttgtgaaattataaatctggaaattttcagaagctgtattatgaagaaagctattacagactgctgtaagacacctgaaagaaacataactcttttacagacactaattatcattcacctttaaagagtgttctaagtaattatattttggttaatttgttagtatcattgaaatgactctttcatacaggtacacacacttgtcatttgggtaatttgttgcagagttagaaataacagtatttgttatccatataactttcatcacaaaacttctgaaacttagaggtacttcaataacttattttgacttgatcctattacgttgtgagatactgtcctaattgttttaattctaaattgcaatatgaaaacttgtgtttttgagttttaataagcataatgaattgcttttgatatattgatgcagtttatgtaagaaaacttattctgtgaagagactatcagcatttaagataaaacttacttcataaagataaggcagaaattttattaaaaagataaattagtttattttcaaatgcaggcagtttatactggaagcattacatgttaagggggtgcatgttattgctcaaatataagccatgtgagcagtgaattcatattttaaactcaatcctaaaatgaacaaagtaaatgagcatgaaagtgcttgattaacaataaagtaaaacacaactttaagctatgatactgtaattatccccttgggtaatcttgataccctggacttattttgaatatcagtttttaaagagtggtacagtggttaaaaaacatgcaaacccaaatgacatctggaaattggaattgatgctgatattctaattactgtaaagtccttatatttttttctttaaaataattgtaagtggaaaacattttaagtctgactttttgatagaactggctttagaaagaaagatttaattattgccaacccacacatgtgtataagttcaatgagctacatggcacccatgtgcaggtaatgacactttttagtaggattggtaagagaattaagaacagatctacttataagccattctgaaataaatgagaacacaaatccttagttgcatatgtatacactgtatatacatatatgcagacattgtctataaatgtgtatatgtgggataatacctcattatattttaagaatctcctgtatgtcaggcagtatgctgacatacagaatatacagaatttacctttgtagaaaagtcactacagtttacagttaaattaaaagctgcatacctattaagtaatagagtagaatttgaatgtagaataatctgactcaaaattcatttatcttttctgtcaaaatgactttatttctgtagaaacaattatgaagacaaatgagcctaaacaggaaaaaaaattttctgattaccacatattataccatgtattctgttttgtattttaattggctgtaactgtctcccttactgattcatccttgtatccccagctcttcaaagagtgcctaacatatagtagttacccattaattgtttgccaaataaatgaattaaacgagcaattggttgactcttctcagttgtttgtctatatgctggtatcaagcatatattcttacttaggttgagttattatccatcatggaactaaaatccaaattcaaattcgttagtttgataatattcttatcttttatttgcaaatcttaatttctattttgacttcagctgaaatgttatatcagcctgtcagtctacagattgacaagatctagccaagtatagataaagcttaatgcaaagttcatatgatcaagttaatttaatagcactttaatgtataatttagacatttgtgaattgataggatattcaaatgaaatgaatttcctagcttaacttctcaggaaactcagataattagttcaaatttagacatagtgaaatggaggtacctgcagtttatcaaggtgaataaatccagaaagtagttgaaaatggaattttaaagtttggggcatcccgagatatattgtctaatacagtagccattaaccacatgtgactatttaaactactagagttaaataaaattacagattcagtttctcatccctactagtcacatttcaagtgctcaatagccacatacaactagaggctgttatatcagacagcacaaatgctataggacatttctgtcatcacagagagttctgtcagacagcactggtgttgaaactggaggaaaggatttaggagtcatttggagatggatggtagttaattgagcaaacatttgttcaacctatgtttttgtaaatttactgtggtctctgtaactataaaaacagatcgatgtctaaatgtaccactctagtctctgtaactgtaaaaacagattgaagtcttatgaaaggcttgtgttgtagtggaggtgacatcatgtaaacaactaaatacaatttagtgctaagtgtcataatagaaggatgtacagagtgctttgaaccttagaatgggaataatctaactttgctttaggatggcagaatcttgaaggatgagtagagttttctgaagaagaaattctatgttcacagtcatagtggttgagaagccctgttaggaaaatattagcagaaatcaagtctgaactaattgtcatgccaaagaatagtaagtaagtcacagaccagaaaatgaaggtgaggctattgaccattagaacactacactgaaaggagtagaacagatggatatctggaaagctaaaggatcagtataggaaaatatgaaaagtaaagagtatgcagatcctggaccagttgaggagaaatctcataagcattgtgttctaggtatattctctttcatgtgcgtccacttggctaggctagaggcaagtccttaaattgaaagatctatattgataaaaaataatactactaagagctactcatacagcacttacagtaacagcgaatatgtgcatagatagtgcttactatatgccagtcactgttctatgcacttattatatgttaactcatttaatcatcacaagaaccccatgaatgctgaagtaatttgaaggcctttaaccatgggttggaggaatgaatggtttggcttagctaaccattgctaaatgtatgttattaactgtcattcaaggatacaaggcacagaggattttctcctttattattgctatcaaccaccagcaaacgtaaaggagcagttggataaggaggagatagaaggattaggcattccaaatatttatgtgctttctgtaacttgggggttgttatgggaggaattgtcatgtccaccccctaccccctgccacaacccaaaattgatatgttgaagtcctcaccttcagtatcttcagtacctcagaatgtaactgtatttggagatagggtgaaacgggagagttccctggcctcacccccctcacagtacatgcaacagaggcatgcctctctgttcagccactgagagctcaaaccccttatgggagcgggaactcgcagatgggcaggtgcaggagccagagcaagcactttgtgctctggccccatgatagtgtctacagatgggtgcctgtgactcccaaagcccaagtgggcattctacagtgcactcttagttttgccgtccacagatggcttaagtgccttcttggcacccaggttcttgtgcagagtccaggaagaataaggacttgaagagtgaatgtgggggctttattgagtggtagaagtggctctcagcaggatggatggggagctggaaggggaccaagtgggaagattatcttcccctggagtttggccatccagcggccgatctcttctctgattgtccccactgaactcttggtgttcaggcgctccttctctgtgacacgttctgccgtttgtctgctcatctccttctggagcctgggtttgggatttatatgggtacaggatagggggtgcggtgggtcaaaagacaactttttgggcatgaaaacaggaatgcctgttctcacttagggccacaggtatccaggcttgagggtggggcctttgccaaggaactgccctcttctacccactatttccctgtctcctgtccatatcattttccccctctaaagagagggtgagccctaatccaatatggctggtttccttataagaacaggaaattaggacatagacacatacagagggaagacacggggagaagatgccatctacacgtcatggagaaagactacggaggaaaacaatcttgccaacaccttgctttgagacctctagccttcaaaattgtgagaaaataaatttctgtggttcttttttatggcaaacctagcaaattaatatggtagccaagataatttatttgtaaatattgggaacatgaatatatgtttttgaattctgggttgattttcttactgtatctactaaatccttcaccaagttttagaagtagagatgtgagatgtttactttgttgttctcagacctaacaatgtttgtgaagaatgcaagtcatgttccttttgggataaggcgagaaagttaacttatatctgtaaaattgatgccattcataaacatttttctttaatttttttctgtaatttggttttgtagatttttttttgcaaaaatataggtgaacaagaagttaggggaaaaatacagattcttcaccctccagagagggacctgaatacatatacagtattttgaaaaagtcccaggacaattctaagacatcatcccttccatctggtgcacatcttctcatctgatagattttggtggtgctgcgggtcagatgtaatgttatttttcctgttctcttttgtatgtaagaaacttagactgatagatattaagtaaaattgaagtaggggaccaaggaattgtgtattaccattggaatgtaaactaatatttttcaaagttagtaaggtataatttatgcataggtataatcttttctataataccaatcttttgaataataccaataattttctgttaatttattttttaaaatctggattgtactaaatggtatctcagacatcacttagctctaacttttcccaagctgtaggctctgtttgtttagaggttcccgtcaggcttgcttgtctctggtatcaatgctcctttgtccttcctcactccagagatatcttttgctgctgtcctgcttttttgaaacttagttttctcccccaagtaaataattttatatatgaacctcttaaatcttatctatcctcttctgtaacttctccaagccatcgtatcttttttatcgtttattaagaattgcagtgagcattaaattttagtcatattttgctgtatttttgtagttttaactaacatatatactgggcatatttataactttaatcagtgacttttcattatcatactttttctgtttttgttttttgttttttgttttttctgagacggagtttcgctctttttgcccaggctggagtgcaatggcgcaatctcggctcactgcaaccttcgcctcccggattcaagcgatcctcctgcttcagcctcccatgtagctgggattacaggcatgcgccaccataccccgctaattttgtaattttggtaaagactaggtttcatcatgttggccaggctggtcttgaactcctgacctcaggtgatctgcctgcctcagcctcccaaagtactgggattacaggcgtgagccaccgtgctggccctgttattttttaatgtgacagttttgtgtacatattttcatatgtcatcgtaggacacttgtaagaataacttaaaggtctacatggtatggcattatttgcagtcatgataaattcttatctgccctttggtagtagccgccttaccaaagacatgttttaagcatatgtttatctgttattcaagaagtaatgtaattattagtagtactgaataagtaaattcaggatacactaaaaatgctcactaattctatttatctctgtttaagatgcttaaagttggactgttggcatatattcagacaataatttttatcaattgcctactcacccattatcggcactaataactcaacccagatattagaagttcccaccatttgcacttacggatggcaaaggaaaactcctaggtatcacaccagtagagcaaggtcttcaaaatgccaccaaatctattgctagaaatgaaagaagtgaaagaaactgaggagagaaacatagtgcagaatttttacaaatggtgtaatgaaactgtcagatctgaactctgatctttaaaatagttgggagttggaagatcagcagtgcatctgagataagtgcaaacttaagagtatggttatttgtttctatgaaatttaaagatattgaaggatttagtttttaaaagtctaataaagtactttataaccactttatgatagtatatttgtaaaaggtgctctgtaatatacccctgtgcaaatagagacatcaatgataagaatcacagaatgatggataatttaccagggttcctcacctgtcacacttataagagttacttggtttacaggatttttgtagtcatttcatttatgattattctggaaacagtttttttgacatattttatctcaggtaatataactagtttataatttgtagttcttctttcactcttccctccgctcatcatattgtactattataatgagattatggaaaattccactgcatttgtggcagatgaatgtaaaatagcataggaatccagataatttgaagatatatgagtcctgcattttggagctggccaaaagtttgattatttgccagaaacctgtgagtgggcgtagcatttagacagggacctttattccaaagtagccctggtttaatctggcatgttggcgaaagtacatactacacatacatctgtgtatgttaatttcttctaatctcatattttctatttagtcttttaataattccctaaaataactatttcagttgatatttactcagtggcctaacttgaatcctatgactctttctctgccataccatgaaggcggttagttttgtctattttgtttactactctatcccaattatctagcacaaaacctcacgttacaagaccttagtaactgattgttgaatgaattaatcagttccacacccttcctagtccccactcttcagttgtttattcattgaacgaaagtttattgaaaacctattattggctaggcacagtggctcacgcctgtaatcccaacactttgggaggctgaggcgggcagatcacctgaggtcaggagtttgagaccagcctggccaacatggcaaaaccccatgtctactaaaactactaaaattggctgggcgtggtggtgggcacctgtaatcccagctactcgggagggtaaggcaggagatttgcttgaacccaggatgcggaggttgcaatgagccaagatcatgccactgcaccccagcctgggcaacaacaaagcgagactctgtctcaaaaaaaaaaaaaaaaagaaaagaaaaagaaaacctattatcagccaggctctaaggtgtggaattttataagacaagttgaagtgtttggtttcatagtgagcttttattctagtggagtggaaaccactcaatataaaaccaaataattgcacaaaataatttcagatagtgatgagtactagataaaaaataaaatatatgtgaggggtatatataccctacaatttggtcgtcagggagcgtcttcctgaggagatgacatctgagatatgggagtaaaaaggagccagccttatgaagatcttgggagaagagccataattttaatattcccctaaatacaacttatatatcaatagaaagatatttataaaatccattgtaaagccatctacttgcatcaaatctccaagatttgagtatgtccttgggacgaaaaaccccaggctggaaaaggtaagtactttttttcttgtattttttctcctggttatctttgattactctttgttatctttggtgactctgattactcttacaactattttatcatcttccagcatttctttattttctgattcgctatttctgctcatatttttgtttccttccttttattttcgttggattagctatgccttttcttactgagttggacacttaacatactaattttcagctgggtacagtggctcatacctgtaatgccagcactttgggaggccaaggtgagaggatcgctagagcccagaaatttaagaccagcctaggcaagatagtgagaccctgtcaaaaaatagaaaaaaataatgaggtatggtgctgcatgcctgtggtcccagctgtaatacttgggtggctgaggtgggaggattgcttgagtcagagatgttgagactgcagtgagctgcgattgtgccactgtactccagcctaggcaacagagaccctgtctcaaaaaaaaattaattgttgttgtaagtatttagaggtctgtattttttgataaatacagtgttgtctgcatcctaaggtcttactgtagaatgttttggttacagttcgtttctgttccttttctatttttcattataatttcttctttgacttatgaattattgaaacttttacagacattttctgtttttgttttttgagagccagggtctcattctgtcaccaagactggaatgcagtggtacaatcaaggctcacttcagccttgacctcctgggctcaaagaatcctcccacctcagcctcccaagtagctgggactataaatgtgtgccaccacacccagccagttttttttttttttttaatattttgtagagacagggtcttactgtgttgcttaggctggtcttgaactcctgggctcaaggtatcctcccatcttggctcccaaagtgttggaattacaggcgtgagccactggacccatcctgcaaacatatttttaagctgttaaaaaattattttatttttaacttttgtgtacattgaagacagttaatactaatttctttgaaatttgtgaaacttgatttgtgctgttctatgtggcccattcttaaatttttttgctccacttctttatgtgcttaaaatgaaagtatagatttaaattgttaggtgcagtgttctttccgagaccatttaggtcaaactaattgataatgttgttctgatattctgtatcctttaatattttgtctccttgttctgttaattacagagataagtattaaaacatgctgtcatgatagtgtaattggaatatgatccttgtaatttttttaattcaatttgattttctgtttttttaagtaagcaaaactttggccatttttttttctaagtcttaaggtttatttatactaatgattgcattgtacaatgctttataatttatatttacaaccccccataaactttttgtattctggattattccttcacattttctaatattcagcataatgatcaagcatacttcatatacattgacccctctccttcagcaactcaaaagattaaataaatactgtagaaaaaatgaagagatgacctgaagacttgatcatctacatctatgtgacagaagagtcagttctttgtaatgaaatactgtaagaatgaagaattaacaaattgtttgtagtttaccagaaaagcatattaactcttttcaaaaaccactgaataaaagtaaaatgaatcccttaagttgcattctaattagcagactggtttccatatctcatcattctcatagtcttctgttgtcatgtcttcttccgtgtctccttgggatgaaaagggctgaggctggttggcaggtaattcattctcactattctgactcaaagataccaggttttgggttcagtggtttgagtgagttcacccagagcttcctctacaagctgtcctccattaagctgtgcctcctctctgctgtcagagtctattattccatgctccccataaggtagggcttccattttcagtcttccaaagtgttgctccagagggagctttccaatgtcttggatgaaagaagtctgaggccgggcgtggtggctcacgcctgtaatcctaacactttgggaggccgaggcaggtggatcacaaggtgaggggtttgagaccagcctgaccaacatggtaaaaccctgtctctactaaaaatacaaaaattagccaggtgtggtggcacgtgcctgtagtcccagctactcaggaggctgaagcaggagaatcacttgaacctggcaggcagaggttgcagtaagctgagatcgtgtcactgcgctccagcctgggcgacaaagtgagactctgtctcaaaaaaaaaaaagaaagaaaaatctgagcttgatttctcatttgaatggttaacagaacaagatatagcaatagctaagtttggagacataaagctggtaggcagaagtcaggaaaagtgcttttgttgccaggccattttttcaatactttttgtgtgttagaaactactggggtttgtgcaaggttcaaaaacttgattgttcttggcaatgagcaaaccctcaagatttgttgaaatgtatcacatctttcatagctgtagatgtactaccctgagtaaagagcatgtattcttttcacaaatggggatatctgcaaaactcagaaattcactggctctcataagatttctcctttccctttcctttcccttttcctttccctttcccttttcctttccctttccctttcctttccctttccctttgcctttccctttccttttttctttccctttccctttccctttcctttccctttccctttcctttccttcttttttaatggaatctcactctgtcactcatgctcgagtgtagtggtaccatctcgactaactgcaacctctgtctcccaggttcaagcaattcttctgcctcagtctcccgagtagctgggactacaagtgcgtgccaccacggccagctaatttttgtatttttagtagggatggggtttcaccatgttgcccaggttggtctcaaactcctgacctcaaggatactcctgcctcagcctcccaaagtgctgggattgcaggtgtgagccaccacacccagccaagatatctactttcattaaaaaaaaatccctgtagttttggtgaagatataaattaaataaataaccctcctggcatgtgtgacatttctactacttcctcagtttgaacaagtaatatatcccataccatactctcttaaatgagaaggcaacaaaggtgagtctagttctgttaaggatgctcttctacaatacattttttcctaaagctctgaagagaaacagagaaacaactttgccaccaatagcttggacctcttgattttcaaaaaccctgtcaggatgttttctttgttttgattttgacagcatagcatctgattttaatgacagtcctttttttttttttttttttcgttgtcaaataaattgtccttttcttttgaaggagaaaactggaggctgtttcttacactttagatacatccttgacagagcaattctagagaagtttttatcagggacaatactttttccttcattcttgttaccatctaaagtcagtattcaattaagaaattttatcataattgttgttgccacagggttgaagctaatatttgagatagaacactcttcttgaattactctgggaaacaataacctttgattatttccattgagactgtcagaaactataaatgtaagaggacatcgggcagtctgcacattctttcttagaacttcatgtaaagtatcagaatctcaacagaactaatcagataaatcttcaaccaaaattatgttcttatcagtcctcagatcatttccaagcatttgtagcttgcgatgctttgttgcccttagtaacaactctttgtaaactgagatctaagactgttagggaaatataaggcagcttgattcaggattaaacatcttgaaacaatctttttggaagtctgttaaaactggattaatcaatccactcttgtacttgaataccatgcttctttgatagtatttttatactaattgtctttccacatctaaaaggacttgttatgaataaaatagatataccctgtttgggttgcctttctaagacttgaacttttatccatgtttcaacttcagttatcttctgcacatcaagttcatgcagagtttctggtttatatttatacacccatgattcattttcagacagatattcttttaaattttttagagcttaaatctgttctaaggaagataactttttttctatgtggaaatctattactttctaacatttttttcttgtataacatgagtgattcacacctaatggtgtagtaatagtgttctcactgttctctgaaaaatcatcacataatgagtctacccagtcttccgcctttgtggaatgtaaaccaaaaagtatctaaggaaagtctctttttaaaaagttaaaaagttttttttttatttcagtaggtttttgggaaacagttggtgtttgcttacatgaatacgttctttaatggtaatttctaagattgtggtgcacccatcatccgagcagtgtacactgtacccaatgtgtagtcttttatccctcacctccccccatccagtcccctgagtccccaaaatccaatatatcattcttatgccttaaaccaaacatatgtttgcttttccattcctgagttacttcacttagaataatagtctccagttccatccaggttgctgcaagtgccattatttttttttttttaatgcctgagtagtattccatggtgtatatatgccacattttctttattcactcattgattgatggacatttgggctggttacatatttttgcagttgcgaattgtgctgctataaacatgcatgtgcaggtatcttttttgtacaatgacttcctttccactgggtagatacctagtagtggagttgctagatcaaacagcagatttacttttagttctttaggggatctccatgctgttttccatgccatagtaggtataccagtttacattcccaccaacagtgtaaaagcatctattattttttgatttttttgttatggccattcttgctggagtcagttggtattgcattgtggttttaattcgcatttctctgatcattagtgatgttgagcatttttccataggctttttggctatttgtatatctttgagaattgtctgttcatgtccttagcccactttttgatgggattgtttgtttttttcttgctgatttgtttgagttctttgtagattctggatatagtcctttgtcggatgtatagcttgtgaagattttctcccactctgtgggttgtctgctaactctgtggattatttcttttgctgtgctgaaactttttagtttaattaagtcccatctattaacccttatttttattgcatttgcttttgggttcttggtcatgaagtctttgcttaagccaatgtctagaagggtttttttctcagtgttatctgctagaatttttatggtttcaagtcttagatttaagacttcgatttatcttgagctgatttctgtataaagtgagagatgaggatccagttccattcttctacatgtggcttgccaattattccaacactatttgttgaataggatgtcatttccccactttacatttttgtttgctttcttgaagattagttggctgtatttggctttatttctgggttttctattctactccaatgatctgtgtgcctgtttttataccagtaccatgctgttttggtgactttataatatagtttgaaatcgggtaatgtgaagtttcccagatttgttctttttgcatagtcttgctttggctatgtgggctctcttttggttctgtatgaattttaggatttttttttaagttctgtgaagaatgatggtggtattttgatgggaattgcattgaatttgtagattgctattggctgtatggtcattttcacaatattaattctacccaatattctatatagtaatattaatgaattaatattaattcgtgagcatgggatgtgtttctatttgtgtcatctgtgatttctttcagcagtgttttatagcttttcttgtagacgtctttcacctccttggttaggtatactcctaagtgttttatatttttgcagctattgtgaaagaagttgagttcttgatttgattctccgcttggttgctgttggtttatagcagacctactgatttgtgtatattaattttgtatcctgaaattttgctgaattcatctacagttctaggagctttttggatgagtcattagggttttctaggtatatgatcatatcatcagcaaacaacaacattttgacttcctcttcaccaatttggatgccctttatttctttctcttgtctgattgctctggctaggacttccaatattcactgaatagaagtggtaaaagtgggtgttcttgtctcgttccagttctcagggggaatgctttcaactttttcttgttcagtataatgttggctgtgggtttgtcatagatggtttttattaccttaaggtatgtcccttctatgctgattttgctgtcttaatcataaaggggtgctggattttgtcaaatgctttttttgcatctattgagataatcatgtgatttttgtttttaattttatgtggtgtatcacatttattgacttatgtatgttaagccatccctgcatccctggtatgacacccacttcatcatggtggattatctttttaatatgatgttggatttgtttagctagtattttgttgagaatttttgtctctgtgtttatcagggatattggtctgtagttttctttttttgtttcgtccttccctggttttggtattagggtgatactggcttcatagaatgatttcaggaggattccccctttctctttcttttggaatcatgtcagtaggattggtaccaattcttctttgaatgtctgatagaattcagctgtgaatccatctggtcctggcctttttttttgtttgcagtttttttcattaccaattcagcctctcttcctgttattggtctgttcagagattcttcatcttcctggtttaatctaggaggctgtatatttccaggaatttatccatctcctctaggttttctaatttatacacataaaggtgttcatagtagccttgaataatcttttgtatgtctgtggtatcagtagtaatagctcctgttgtgtttctagttgagcttatttggatcttctctcttctcttcttttcttttcttttttcttttttctttttttgagatggagtcttgctctgttgctcaggttggagtgcagtggcgtgatctcagctcactgcatcctctgcctcccatgttcaagcgattcatctgccttggcctcctgagtagctgagtttacaggcatgtgccactatgcccggctaatttttgtttttttagtagagacagggtttcaccatgttggccaggctggtcgtgaactcctgacctcaggtgatccacccctcttggcctcccaaagtgctgagattataggcgtgagccacggcgaacagccttctctcttcttttcttggttaatctcactaatggtctatcagttttatttatcttttcaaagaaccagctttttgtttcatttatgttttgtattttttttgtttgtttccatttcatttagttccactctgatgttcgttatttcttttcttctgagtttggatctggattgttcttgtttttccagttccatgaggtgtgaacttacttagattgtctgtttgtactctttcagactttttgatgtagatatttaatatgatgaactttcctcttagtgttgcttttgctgtatcccagaggttttgataggttgtgtcactattatcattcagttcaaagaagtttttaatttccatcttgatttcatttttgacccagtgatcattcaggagcaggttatttaatttccatgtatttgcatgcttttgagtattccttttggagttgatttctgattttattccactgtggtctgagagagtacttggtataatttcgattttcttaaatttactgaaacttgttttgtgtcctatcatatggtccatcttgaagaatgttccatatgctgatgaacagaatgtatattctgcagttgttgggtagaatgttctgtaaatacctgttaagtccatttgttgtagggtataatttaagtccattgtttctttgttgactttctgtcttgatgatctgtctaatgctgtcagtggagtattaaagttctccactattactgtgttgccgtctatctcatttcttaggtccagtagtaattgttttataaatgtgggggctccagtgttaggtgcatatatatttagaattgtgatgttttccttttggagtagtccttttatcattatataatgtctctctttgtctttttttaactgctgttgctttgaagtttgttttgtctgatacaaggatagctgctcctactcctacttttggtgtacatttgcatggaatgtctttttcagcccctttaccttaagtttatgttagtccttacatgttaggtgagtctcctgaagacagcagaaacttggttggtaaattcttatctattctgccattctgtatcttttaagtggagcacttaggccatttacattcaatgatagtattgagatgtgagatactgttctcttcattgcactatttgttgcctgaatatcttgggtttttgttttgttttgttttgttttttcattgtgttattgttatatagggtcctgtgaaccttatgctttaaggaggttctattttggtgtattttgcggatttgtttcaagatttagagctccttttagcagttcttgtagtgctggcttggtaatgaatgaattctctcagcatttgtttgtctggaaaaggctgtgtctttccttcatttatgaaacttagttttactggatacaaaattcatgactgataattgttttgtttaaggaggctaaaataggacctcaaccccttgtagcttgtagggattctgctgagaaatctgctgttaatctgataagttttccttttacaggttacctgatgcttttgcctcacagctcttaagattctttcctttgtcttggcattagatgagttgatgactatgtgcttagacgataatctttttgtgatgaatttcccagtgctctttgtacttcttgtatttggttgtctagatctctagcaaggctggagaagttttccttgactatcccctcaaatacgttttccaaacttttaggtttctcttcttctttgggaacaccaattattcttagctttgtacgtttaacatagtcccaaacttcttggaggctttgttcatatttttaaattcttttttctttgtctttgatggattgggttaattcaaaagccttgtcttcaggctctgaagttctttcttctgcttgtttgattctattgctgagactttccagtgcattttgcatttctctgagtgtgtccttgatttccagaagtttttattgttttttattcatatttatgctatctatttcactgaagaatttttctttcatatcctgtatcatgtttttgatgtctttaagttggacttcacccttctctgatgcctccttgatttgcttaataatctaccttctgaattctttttctggcaatgcagagcttttgtcttggtttgcatccattgctggtgagctggtatgatcttttggggatgttaaagaatcttgttttgtcatgttaccagaatttttcctggttccttcccattggggtagactatgtcagagggaagatctgagattcaagagttgctgttcagattcttttgtcccatggggtcctccctttgatgtggtattctccctgttgtcttatgaatggggcttcctgagagctgaacttttttttttgaccttctgggtctagccactcagtggaggtactgggctccagactggtactggggagtgtctgcagagtcctgtgatatgatccatcttcagatcttgcagctgtggataccagcacctgctccgttggaggtaacaggggagtaaagtggactctgtgaaggtctttggttgtgtttttgtttagtgtgctggttttgtgttggttggcctacagccaggaggtggcactttcaagagtgcatcagctgtggtcctatagggaggatgcaaacttgccctagggacacctggttaagttttcaggtgtctcaggtggtggacagggccatagagctcctgagagattacgaccattgtcttcagctaccagggcaggtggaaaaagaccaccaggtgggagcagggataggtatgtccgagcttagcctctccttgggcagggcttgctgtggctgctgtgggagatgagggtgtggttcccagtccaatgaagttatattcccagggggtttacagctgcctctactgagtcatacaggtcaccagggaagtctgggaaagccggcactcacaggcctcaccctgctcccactcggccgcagtcctgaaggccagtctcattccaactgtaactccccaacagcaccgagtctatttctaggcagctagtgactagggctgagtacttgccccagatcatgagcctccccattcagaaagcaagcagactcacagtttttcggcattttggggagcctgcagtggtgatacagttgctttagagggtctgtggattctcccggctttcttagtatgtttctgtggtagttcttgaagcaaaagtttatgacatgagtctccacatactgttctgtctgagtgggagctgcaagctagttctgcctcctatttgccatgttaatcctgaaacaggtctcaaacagtttagaaatttatttcattagggttacagatcatgactcatgacacagcctcaggatgtcctgtgaacatgagcccaaggtggtttggttatagcatggttttccatgttttagggagacatgagacatcagtcagtacatgtgaggcatacagtggtttggtctggaaaggtggaataactcaaggggtgttggggggtggcttataggtcataggtggattcaactattttcttagtggttgaaggagctattataagacctggaatcaatagaaagaagcgtctaggttaaggcgttgtggagaccagcgttcttattatgtagatgacgtctcatatgcctccacccccagaggcaatagatggcaaatattccctattcagagccttagtaggtgctagagcactcagccaatcttttcagaatcaggaaaagtcctggaaggggaagaagattctctagaatgtaaatttcccccacaacagacagcattgtagggccattgcaaaatatgtcagagaaacatattttgaggtaaaatactttggtttcttccagggctctgctgtcatgtgatgctacactagagtcaggttggagtttggtatcttgtttctgcaaagagtctgttctgtcagtcttaggatctctattttaatgttaatgctggtcagttgtgtgcctgaactccaaagggaggagagtataatgaggcatgtctaaccactcctttcgcatcatggtctgaactagtttttcaggttcagttgggtcctcttggcctaaaagagggtccttagtcaggtagggcacttagaattttatttttagttaacagaaagatgcctttggtctaagaaagttttgacattataaactttaatagttcatctgtagtatacaacctgtagtatattaaaacataattcatttccattaaaaagaatgtaatggttgatgccagattcctgaaaggagacatcagagatagaagatacattcaggactattcctatcagacccactactgccccacacattgcacagaggatagtaaactcaaacttcattcaacataatcttgtaatcagtattgagccatactgagcatgcatgtccctgctccaggctgtacccaaaccaccttgggcacatgttctcatagtgcatatttctgcactctcacctttctcatctccagatgggatgggcagtctggaaggaagaacagtaagagcccaggaagacatgaaggcagagatggactcacatctctatgacatatatacaacatagccatggtcaaggtggccttattctcccagagcggcgtcccctcatgggcagagaggagctcaagccctgcttcaggtggaagggcagttgcctggccctagccaggatcaatgctgagcccctcggaggtcctgcttcccagggaccctgtttatattttatatttatatttggatttatttctaactttatttttttttctattcactctacttttttctctttttctacttcatttgtggtgagggtcttttaatgctaaactcaatttttacctgagatatcttcatttcattttctttttgaattacagtttagaaatatgattaatttctaggttgatagttgttttcttaaaattctgaatatactagtacattgtatttcactgtggcagttgggaaatttgctcttctttttttttttcttttttagagacagggtctcactctgttgcccaggctggggtgcggtgtcacgttcgtggctcacttcagccttggcctcctgggctcaaggaatcctcttgcctcagcctcctgagtagctgggaatacaagcatgcaccactacacccagctagtcttatttctttgtagagatggggccttgctgtgttgcccagtgtaaaccaaaaataaaatcctaaggccccccaaccatctgaatagacccccacctcttggccagggcactccaaagttaacctgcaaaatgggttcagggcatgacgagaagggagggtaatacatgccttataccctcctcccttttggaatttaggggaagccaaccagcatttaacatcaacacagaccttaaatttgataagaaacatttataatctttattctctgaagcctgctacctggcgtcatctgcatgataaaatttggtctccacaaccccttatcataacccagacattcctttctgttgataatagctctttcaaccaattgccaatcagaatatttttaaatctacatataacctggaagccccctgccccttcaagttgtcctgcctttccagatcgaaccaatatatatcttacatgtatttgattgatgttttatgtctccctgaaatgtataaaactaggctgtgccccaactaccttggacacatgttctcaggatctcctgagggctgtgtcatgggccactagttactcatatttggctcagaatatatcttttcaaatattttacagaggccgggtgtggtggctcacacctgtaatcccagaactttggaaggctgaggcaggacgatcacttgagcccagaagttcaagaccagcccaggcagcatggcaagaccccatctctacaaaaataaaaaaaattaactgggtgtagtggcacgcgcctgtagtcccagctactcagaggctgaggtgggcaggttgctttgagcccaggaggttgaggatgaggtgagccaagaccatgtcactgcactccagcctgggcatcagagcaagaccctgcctcaaaaaaaaaaaaaagtgcagtttaactctttgtcaacactaggctggtctcaaactcctggactcaagcaatcctcctgcctcagccttccaaagtgatgggattatgggcatcagccaccataactggccagaaatttgctgttctaattgttatttctttataagtaacatgtattttttctctctggaagcttttaagatctctttgtttttggtgttgtactatagtgtgtctaggagtggattttgatttctttattcatctagagacttgtgcttcctgattttgagaattcatgtcattaagtcactgcagaaaaattcttggctggtttgtctttaaatgttgcctttcttcattctctgttcttctcctgcaactcctattaaaatgtattttggactttcttattctatcttctgtatctcaacttcctttctatattttacatattttgtttttccagttcacctgttttctactgggattcaatatgctgtttaactatttcattgttttgtttcttttaacttcagtgaccacattttcgaatttcaagcagtttttattgttcttcttaaatctgcagtctgttttcatagtttattatcttatattttaaattcctttttgtgtcttcagatatttagacatttttaaacattttaaacattttaatgttgtctctttcctaaaaccttgttatctgattttaggaggtcaaaacctacagtttgttttgtcttttattgatttacagtggactaattcttcatgatttatattttgatattgtgtattcatttcatgtgatctttttgtctgggaattctcaataacttggtttaaggatatgtcttcaaagacatttgtgttggctttttccaggtactcaggcttgatggaccagaaactaacttgggggttatttttttgtctaggggtttctagattatatagctaatatagatttagtccccagattcatttgaaggtaaatcagtagtcttgaattcctggaagagacttttgcccaggctatgatgtaggagctttcttacgtccttctgttgaaggtagaagggttctaattattcttttactaaatgcgtagtctttaggggagctggatttacacagaacatattaatgtaaactcactgctcactttggactactggctttatctcctatttcttaacgggttttgaaactcagccatttagttaccaaagccatcagccacccctcttatgccagataaactctcaacttctacttgctgctctaatttttcatttcctctttgttcttagctcttttttacaaatttatgcatttgttatcttataccttgcatttttggttgttttgtggggatgatttttaggatatccaatattcatgttgccattaatagaagtttccaaaaagcacactaacatgttctaatatacttttaatgcattagttttctaccttatttaatatactaataatgaaattttaaatagaatttttgttctcaaccaatatcaaactaagcatatatggtatcttggctttaaaaattagaatgacttattgaaaatctggtgactagtcaattccattttgttttagttaactagcacactttctgattaagcagttctctccattctctgcaaaatgaaaagaaacacaggattttagtagagtagtatttttcctaaacacaaatactatggactgaattgtatctcccccccaaaatttatatgttgaagtcctaacccctagtacctcagactgtgcctaagtttagagattagatctctaaagaagtaattaaggtaaaatgaggtaatatgggtgggccctaatcctgtagcaggacaagccacagacaaacccctcagacaccgagttaaagaaggaagggctttattcggctgggagcttcagcaagattcacgtctccaacaaccgagctccccgagtgagcaattcctgtcccttttaagggctcacaactctaagggggtctgcatgagagggtcgtgatcgattgagcaagcaggaggtatgtgactggggactgcatacaccagtaattagaaaggaacagaacaggacagggatcttcacagtgctttttttatgcaaataaccgattaggtcaggggtcgatctaactaccaggcccagggtgtggtgcagggctgtctgcttgcggatttcatttctgccttttagtttttacttctttctttggaggcagaaattgggcataagacagtatgaggggtggtctcctcccttaatccaatctaactaatatccttgtaagaagaggaaatttggacacacaaagggacaccagggattcctgcacaagggaaataggtaaggacaaagcaagatggcggtcttccgtaagccaaacagaaaggacccagaagaaaccaaacctgctgacaccttgatcttggatttctagcttcagaactatgagaaaacgaatttatattgtttaagtcacccaacctgtagtattttgttacgtcattcctagcaaactagtttaagtgtctgctgacttttcaggattcatcttttagtatgttgtctatggctttactcttttcctcaagctaatatttatttcacaccattcagattaacagtcttctaattggtagctttgcttttgaaatggttcactcttcattctttcaatactgctgtcagagccatctttcaaaaatgaaatttgtacctagctttcagttcccagtttctaaatactgcaccccttaacaggaccagaggtaaggtacaaagtgagctcagaacaatttgtcatgtcagaaagttaaaaagtactcacaaaatgttagatacatgttaggatacaagtacctgtagatgattccatgggaaaagaatagtcttcaagaaatgatgatgctaggacaactggatatccgcatgcaaaacaatgaagttgggcctctgcctcacatcatatacaaaaaaaattaacttaaatggatcagcaacctgaatataaaagctaaaactatagaactcttagaagacaacataggggtaaatcttcatggccttggatttgacagtggattcttaaatatgacactgaaaacgcaagaaacaaaattagacaaatttgacttcattgaaattaaaaatttttgtgcaccaaagaacattgtcagagatgtgaaagacagtctatagaatgatagaaactgttttgtttttgttgtttgtttgttttgggatggagctctcgctctgttgctcaggctggagtgcagtggtatgatcatggcgcactgcaacctcagcctcctgggttcaagtgattcttctgcctcagcctcccaagtggctgggattacaggcacctgccaccatgcctggctaatttttgtatttttagtagagacagggtttcaccatgttagccaggctggtctcaaaactcctgacctcaagcgatcctcccacctcagcctcccaaagtgctgggattacaggcatgagccatcacacctggcctatagaaactatttgtgaatcatgtatctcttaagggtctagcatccacaatatataaagaactattacacagaaaaagccagtccaattaaaactgggcaaatgacttgaaaaacttttctccaaagaagatggagtggccagcaaacacaagaaaagatgctcaacatcattagtcattagggaaatgcaaatcaaaaccaagagatacattatactcactaggatagatataattaaaaaatggaataacaaactggcaagaatgtagaataagtggaatccttatacatttttgttaggcacataaaatggtgcagccacaatggagaagtttggtggttcctcaaaaagttaaacataagaattaccatatgacctaattattccacaagtactatgtggaatatccaaaggaacgtgtatatccaaaagaaatgaaaacaagtactgaaatacttttgtacatgaatgtttatagcagcactattctaaatagccagaaggtggaaatagcctaaatgtctgtcatcatttgaatggataaacaaattgtgatatattcatacaatggaatgttatttagccataaaaaggaaatgctgaggcggggctggtggctcatgcctgtaatcccagcactttggaaggccaaggtgggcggatcacctgaagtcaggagttcgagaccagcctggccaacatggtgaaaccccatctccattaaaaatataaaaattagccaggtgtggtggcatatgccagtggtcccagctactcgggaggctgaagcaagagaatcgcttgaacccaggaggcggaggttgcagtgacccgagattgtgccactgcactccagcctgggcgacagaacgagactcggtctcaaaaaaaaaaaaaaaaaaaaaaaaaagtgctgatgcatgctacaacttgattaaaccttaaaaacactgtactgagtgaaaagaagccaggtcacaaaagatcactattgtatgattttgtttatattaaacatccaaaataggtaaatacatagagatagaaagcagattggtgattaccaggggctcggaatagggtagaatgtagagtgactgcttaataggcataggaatttcttatgagtaatgaaaatgttttggaagtatacatggaggtgatgattgcacaacattgtgaatgtaccaaatgccactgaaggttacactttaatatggttaattttatgttatatgaatttcacttcaataaaaatgttaatagttacagaaattgattataatattgatttttaaaagaatccatgagtccatattgagactaaaaaaaaattaaaattgaaagagggggcttgtgtttgttttagagatgagatctcactctgtcactcaggctggagtgcagtggcgtgatcataactcactgcagcctcaaactcccggactcaagtaatcccactctcccagcctcctaagtagctgagactacaggcttgcaccagcatgcttggctttttcttttctttccttttccattttccattttccctctcttctcttcccttcccttcccttcccttcccttcccttcccttaccttcccttcccttcccttcccttcccttcccttccctccccttccctcccctcccctcccctcccctcccctcccctccccttctcccctcccttcccctcccctcccctctcctcccctcccctctcctcccctcccctctcctcccctcccctctcccctcccttcccctcccctccccttctcccctcccctctcctcccctcccctctcctcccctcccctctcctctcctcccctctcctcccctcccctctcccctcccctctcccttcccctctcccctcccctcccctctcccctcccctctcccctcccctctcccctcccctctcccctcccctctcccctcccctcccctcccctcccctctccctctcctctccctctcctctccctctcctctcctctccctctcctctcctctccctctcctctcctcttctctcctctcctctcctctcctctcccaagctggtctcaaactcttggcctcaagtgatcctcctgcctcagccttccagtgggctgagattacaggcatgaggtaccacatccagtgaaaggctcttcttggagaagaatggtgactaatacatgtagaaagaatgatgttttaaaatcaccattttacagtccccatagtaataattgatttagtaattgcggaaaccattgtgtaaaggattgccagggacaagaatattcacaaagccccgaagtatcaccatgttgattatcactattgaagggaaactgtgcctttctcatagagacatctgacagatactaccttaacaaaatgatcaaaccttacaccacccaggtactctaaaaccatttaccaaaaagagtgagagtgagcaaaagtggcaacacgttaattggtgaatgtaggtgaagtttacatgggtgctaattgaactattcttgcatttttttctataggtttaaaatttttcaaaataagtgggggtaaagatgaaatttggatatgaccctttcctgtttaatagtgttgcctgaaggttaacagttgaactctttagcctactagttaaggatccttatgattcagcccctgtttatctttccagtcttatctttttccatcacatttctcaaactagtttaaatgttagctatgccacactacttcctatttttcagattgctcatgttctctttcaccctcatgacttcgtacacattatatgtgccctctccttgaagtttccttttcctgtctttatcttgcagacttctgcttgtctcgctgaattctgtgtagtttatcatttcttgcaggaatcttccctgatcatcctaggttgagtggatgcttataatgcattgctcatattcctgttataccacttgttacactataagttaattggctgagtacttgtctgttttcttcctagactgggaactccttgatgccttggactgtgatttatttttcttcttttggtgtccacagtacctgcaagagtgtgtgccacacggtagctgtttaagaaaagatttttacataaatgaataaatttcacctcctgctatttccctggatattttaacttaaaataggtctgtttatcttcatttgtacttaatatcagttttatgtgtatatcatgtttggttttcttagttttatttctttttctcaactttatatagtgaatgattttgttacagaaattattagtaatttatagaattctgcagcacaactagtacatgataggatttgatccaataagtatgaacatttcttgcttaactgtactacattgctaagcactgtgggagaatataatagagatgacattttggcaatttagacaatgagctaatgtttcctaacattaaagccaaatctataactcattttctatacaaataaaacttctggatttagcagagatgtaaatatgattttaaaaggaaagaaactctaaatatactaaaaacatttaggtaagttttttttttaaaataatcatgtaatataaagtcctttatagtgctgacctaaaaggaagaagctgaggcaaaattcatggaagtagagcttatttgggccagggtcgaggattgtaaaccaggagcatggattcaagttgccctgaatgtagactccaattagcagcagttacaagtaggttttgaaatgaaaggaagcaattcctaaattgtttccaagaaattacattaatataacaagctattgattgggtatacattattccttgtatcacaaattccaggaaaatgaagataatgggtgagtcagttagtcaggaacaaaatatctttaaacaattgcccctgggcatgggtgcatagggtgtgactgaagtcccatactcacgtctctctgggcctgataaattttacatgcctcacatagctcagactgctctgagctgtttttcttttctcagtaatataaaatgaaacccagaagctataaaggaaaacatattgatataataattcttctacttaaaaatgtaaaactctagtgtagcaaaacaaatttttttatttgaaaaaagagaaagtatctgtgttacatgttatggcaaagggctcatttccttggcatacaaacgactattacaaatcagtggaagaaattcaaacaacccaattgaaaaacaggtaaaggacatcaataaatagtctgtggaggccaggcgtggtggctcatgcctgtaatcccagcactttgggaggccgaggtgggcagatcacgaggtcaggagtttgagaccagcctgacaaacatggtgaaaccccgtctttactaaaaatacaaaaattagccgggcatggtggcaggtgcctgtaatcccagctacttgggaggctgaggcaggagaatcgcttgaacctgggaggtggaggttgcagtgagccaagatcgtgccattgcactacagcctgggcaacagagcaagactccgtctcaaaaaaaaagtagtctgtggaaaaagaagattgctgataaatatagaaatattgccccccgccccccccccaaaaaaaaaacaacaaggggtttgttcacctagcaagcaacaaacaagtgtccacaaaaacacaggttttgaccaatagaagttttattacctatcacaaggaaagagatcactgagagtattctccaaagcagtgtctccctgagggaaagtgacaggaaggtttcatggatcagtggagaagggagaggatacgtcatcacatgtagaggaggggccccagtggcgcagacacagtcagtcattatgccagcacacaggttgcatgtaatgataatgatgctatagctcctcctggggtggagactttatagcatggtgaggcggaaagttcacttgggttcatgtgtaagttgctgaggtctgtcagtagctgattccaactgactagatgaccacataacatacagggtttgggaaaaaacaggttgcaaggcaggagggtataaagcaagctcacagttcatgtttattaaattcttatagtccctggagaccttccgtgtctgcttacaatatgttataatgaatgagtaggtctgtatactgctgtggaaaattgtatgagtgaaaaaatccatcatacttttcaattcctgattcagttatctattgttgtgtaacaaaccaactcaaaacttagtgcgtcaaatcagcaaacatttatttgctccatttctgctctctgggcagagctcaactgggcagtctttgcactggtcttgcctagagtcactcacctacttaaagacgtatagagtcaactagagctggaaacctgcaatgggctggtcaggcagctctctctccccatctctgtggcatcttcagcagagtatctggaccttttttacatggtagctcaggaacccaggagggaactttccaagagtcacagggcccagtatctaagtgcttatgaaaaccaagtcacatggccaagcccagagttagtattgaggactacacaatatgtaataccaagaggtgtgattcactggggaccaccagtgtaaccacacttcctaatttatgttacatacctatttatctgtttattgccactcttccattagaatgtatcatctgcaagaggatgggttctgcttatcttgttcacctatatcagcctagaacaagatatactacattgttggatttcagtaaatttttgctgaatatatatgtctagtaagatgttgtgtttaaagaaaatggtgtgtattaggggaggctggtatttctgtgtgcataataaacttctggaaagataaacataatggttttatgattaaacatgatggtttctggatttgaaaaggaataaggggacaagaggggaccttttactctatttcatttacattgtgtatttccatgactgtatcccagttttataacttaatacatagtaaaatatgagaatcattctttatttgtaaaaaaattattttcttagacatttataagaaatactaaaattagagtacaaggccaagcagcttgtaaaaatgatttaaagttgtctggtcagtatgatagagttcttaaaaacattcaagtttatgctaaatgaatgttattcatttacttattctcctactcaacaaagattttttgagtatataataagtactatagtacattgttttgggtatctcagtgacaagattctttgtcttccagagttctattagttcaattggcagacctggttggatgaataggaaaatgccaaattataaaatacctttgaaaattcttaaaaaactgtattcctgtattcgttttggttattaaaatagtcatttggagccaagcatagtaaagattttgagtcagagacaaaagaataaaatagtaagactttttcatttgtgacttctgaactaactctcaaggcaatctagaaaaaagtagttttagttcttctgagttctctagagtagatctctcacccttatagttcattgctagataacctaaagagtatctggcatttatggtgcccaagaaacacttattgaagatatatgtaataggcttcacttactgctgcttactgtgtatgtcacactgtgctgtatgttttacatgtatattatctgttaatccttcaacagccctgtggcaaaatcattatagatctcagttttcagactaggcaacaaagacttaagtaacatacccaaagttacaaatagctattaagtggtgaagcatattgaaagtcaagatcagagatacttcaaagcttatattctttttttttttaacaacattcttttttttttaatatatactttaagttctgggatacatgtgcagaacatgcaggtttgttacataggtatacacgtgccatggtggtttgctgcacccatcaactggtcatctgcattaggtatttctcctaatactttcccctcactgccctcaaagcttatattcttaatgactattcctttttgcccctccaccaaacccattcatatgagactagcattgttttgcatctgtatatgcttgcatgtttattcaaaaaacagtctattttttaattacctcggagaagactttatgggcaaaagtgtagaggcaggaaggaatgtttggctagactagagtggcttataatagacatgacgagatgggtaaagaagtaataaattgtaacctggaaagccaaaggattgtatcatgctgttaattggctattctactaaaaggtcagatgagggaagaactaaaaatttttagttttaaaaaaaattagcttttgggttatttgtagattttaattatattttctttattcttcaaggatatgtaagatgtgcctacatttatgctttaaatatctctgatttgtctatcaactaataacattagagcagtgtctttcgcatttcttaattccctctctaatttccctgtttatccttctctctgtgcagattgttggtttggcattctgtctggatagcctcagccaacaagtattaatagcttggtcaaaacacagaattttgaggaatcattgtatccatagggtaaggtggatgtaaagcaaagatatttaggtagtttagccatgatttattttattaacccatttatgcctagtgtaccattattggaacgctaagcttgtgggagttatttgtatcctgctgctcaaggtcatcgccaaggtccgatttttcacaaaaaaaccttataacctccagcataaatgggttaatttaatcatttcttattgatttcgtctgtcctaatagttcttaatctactttgggtcttggacctctaaaaatctgatgaaaacagtgctcagaaattgtaatatctacagaaagtttatataccaatccaggttgtttacaaaccctttgaatcctatctatgacacccaggttaagaactcttgtgctttatctccatgctggtctcaagtaacatcctacagtaattcaccaccactataaaattttatcactaattagaaaaagggtggaaaagatggaatgctttaaaaattttaagaaccatagatttgttagaatcattaaaaatgtgttggaaataaaagcaaaaggaacatccttcagtctactttcaaaattttaagtatgttttacaggccaagcattgtggctgtcctgtaatcccagcactttgggaggccgagctgggcggatcgcttgaggccaggagtttgagaccagcctgggcaacatggcaaaaccccgtctttatttaaaaaaaaaaaaaaagtgtgtaagtgtgtgtgtgtgtgtaatttagccaggcatggtggtgttcacctatagtcccagctaccctagaggcaatgatgggaggatagattgagcccgggaggtcaaggctgcagtgaactgtgatggcaccattgcactccagcccaggaaacagagtgagacccgtctataaaaaataaattaattaattaattaaattaaataaaaacagttgttggatcacaaaggagatcaagaacaaaatagcagaaaatctaatagtggtgaatcaaccattgtggaatcaaccattgtggcgattcctcaaagggctgaaaacagaattaccttttgacccagcaattccattactggatatatgcccaaaagaatagaaattgttctgttatgtcatgaagatacatgcatgcatccattcattgccacactattcacaatagccaagacatggaatcaacctaaatgcctctcagtggcagactggatgaagaaaatgtggtacatatacaccatggaatactatgcagccataaaaaggaatgagattgtgtcctttgcagggacatggatggagctggaggccattatccttagcaaactaacgcaggaacagaaaacaaatacaacatgttcttacttacaagtgggagctaaatgatgagaacacatggacataaagaggggaacaacagacactagggcttacctgaaggtggagggtgggaggacgaagaggagtaggaaaaaataactattgggtactagatttagtacctgggttgcaaaataatacatacaacaaacccccgtgacatcagtgtttacttatataacaaacctacacgtgtaccgtgaacctaaaataaaagttaaaaaaaatgtactgaaaatactctacatggttaagctgatttaagtaaaactcataatcttaagtgtaggtattattaagaagagaatgaaatgagtatttaactgaaaagattagaaaaaacaaaaaagtaagcctaaggagaacaaaggaaatgatgaaagttaaaagtagaaattaatacctttaaagaaacctttaatacctttaaagatgacggtggcctcctgagttaatcctctgtggcactaccctgcttaaataaaactcttcattgtccttaaaatggctcactagacccttcataacctggttcctatccactgcttactatatttctcacccttcccgtgttcccccacccccatgctccaaccatatagaactccagaatttcttttggttcgttgaacacagtaaacttaatgtcatttccgatccttgtgctttgcccttattcttctctaggccttcccactcttcttgcctggccaattcctactgagtcttcaagacacagcttaaattttacatactctaaaaaggcattgaacatacaaatgtacatacacatacacacaagtgctcaggtaacagactaatttacatactcaatcttcagtggtttgatagcattttactgcccctattatagcacttctctcaccagtcaatatcaaagaagtgtttgacaagaggagtaataattgaggtacaccatcagaaatccaaagttacactgcttaaaattattaaaatgaagcatatttccaaagctacttttgctagagcagatactagtatgagtgagataggccagaatagtatattataagcaaaagaaagtatcctaaatttagcaaattgtattggttaactctcaagggaaaaaatacttttgagtcttcagataaattttagatacatcaaggaaataaatataagcaattaagttatataaaaactaggaaaaataggaactagtactaatccaaacctctggatcagtgttgcctaatagaaatataatacaagccacataagtagtgtttttttaaaatttatttttatttatttatttttttgagacagagtcttgcactgtcacccgggctggagtacaatggcatgatctcggctcactgcaacctccgcctcctgggttcaagcagttctcctgccgcagcctcctgagtagctggggttacaggcacccgccaccacgcccagctaataagtagtgttaaaattttttagtagcctcattaaaaaaataaaaacaggaaaaattaattataacattttaacccagtatgtccagaatattgtttcaacatgtaattgatataaaaatatgaagtaccagagttttttaatactaagccttaaggtttttaatgtatttttaaagatacatgtgatattttgatacatgtatacaatgtccaatgatcaaattaggataattgggatatctgtcatctcaaacatttatctttgttttgaaaacacaacaatcttctagctacttttaaatacataataaagtagtaactgttaagttctttactatcaaatactagaacgtattctttctaactgtaattttgtacctattaactgatttcttctcaatctcacacccaccttcccagcctccagtaaccacgattctattctctacgtcctttagttccactttttcagctcccacatgtgagtgagaacatgcaatatttatgtttctatgcctagcttattttactgaacataacgacctcaatttccatccattttgccacagataacaggatttcttttttttttttgttttgttttttttcttttttttgagacaggatctcacttcattgcccaggttggagtgcagtggtgccatcgtagctcactacagtcttgacctcctgagataaagcaatcctcctgcctcagccgcccaagtagctggaactacaggcatgtacccccatgccggctttttttttttttttttttgtagagatgaggtctcactctgttgcccaggttggccttgcgctcctgagctcaagcagtctttccacctcagcctcccaaagtgctgggattacaggagtgagccaccgttccccagccaggattttgttctttttcatgggtgaaaaatatttcattgtgtatatataccacattttctttatccattcatccattgatggacacttgggttgattccatatcttggctactgtgaatagtgctgcaataaacatgggaatacaaatatctctttgatatactgatttcctttcttttggacatatactcagcagtaggattgctgggtcatatggtagttctattgtttgtgttttgaggaacctccatactgttttccctaatggctataataatttacattcctaccaacagtgtaagagcattctcctttctctgcatcctccccacatctgttatttttttgacatttttgtaatagccattctgactgggttaagataatatctcattttggttttgatttgcatttccctgatgattagtaatgttgagcatttttttatatacttggccatttgtatgtcttcttttgagaaatgtctactcagatcttttgcctatttttaaatctgattatttggttttttttttttgctattgagtcatttgagagccttacatattccagttattaatgccctgccagatagatagtttgcagatattttctcctattctatgggttgtctcttcactttgtttctatttgtttttaagatagggtctcactatgtcgcccaggctggtctcaaactcctgggctcaagtgattctcctgcctcagcttcccaaagtgctgggattataggtgtgagctaccatgtccagctaccttgttgattgtttcctttgctgtgcaaaagctttttagcttgacataatcccattttatttttgcttttgttgcctgtgcttttgatgtcttaaacaaaaaaatatttgcccagaccatggtcctttagtattttcccaatgtttttttctagtagttttgtagttttaggtcttacatttaaatctttaagccattttgagctgattttgtatatgttgaaatatggaactgtagtttaattcttctgcctaatagaaaaccggttttctgagcactatttactaaaaagactgttctttccccactatatgttcttgattcctttgatgaaaatgaattggttgttgagtttcatgtcaaggctaggtgaaaagatagaaaaaagtgagagttaaaaagttaaaaaaaaagaaaatgagttggctctaagtgcatagatttatttctgggttctctgctctattctgttgatctctctgtctgtttttatgctagtaccatgctgttttatagttttatagttttcctggtagagatctttcacttcttaggttaaatttattcctaggtggtttcttttttgtagctattataaattaggttgccttcttgatttctttttcatattgattgttcatgtgtagaaacactactgagttttaaaaataataattattatttaattgcagatggggtcttgctatattgcccaggctggtctcaaactcctgggttcaagcaatcctcccacctcagcctcccaaagtattgggattacaggcatgagccaccatgcccagctaatactactgatttttgtatgttgattttgtgtcctacacctttactaaatttgtttgtcagttctaagagtattttggtggagtctttaggtttttctaagtataagatcatgttgtctgcaaacaaggataatttgacttcttcttttcttctttgtatgctctttatttctgtctcttgcctaatttctctggctggatgtactaagcctttgaaatccagtgtttatttcacacttacagcgcatatccatacaaactagctacatttcaagtgcttgatagccatatggctcttggctatcattggacagcacagctgtagatgaagttaaatatagaagcagtagaagataacacaaaggaaaacaataaataacattggctacaggaaaataaagaatttagtaaagaaaaggcagaaaacaaaaagaaaaatatttgcaacatattatagtacaatattattattcttaatatgcaaagggttcatacaaatcattaaaaacacttaaaaacccaaaagattaacaggcaagatgacacaagcaggtaatttacaaaagagctggtaacaaacttagacataacaatcaaagaaggataaattaaaacaatagtacaggttgggcatccctaatctgacaaaccgaaatgctccaaaattggaaactttctgagcaccaacatgatgccacaagtggagaattccacacccaacctcatctgacaggtcatatgacaggttacaatcaaaacacagtcaataatattgtatgaaattaccttcatgctgtgtgtataaggtatatatgaaacataaatgatttttgtgtttagacttgggtcttatccccaagatatctcatttcatatgtatatatatatacacacatatataaaatatatatgtatatataatatatatgtgtatatataatatatatgtatatataatatatgtgtatatataatatatatgtatataatatatatgtgtatatattatatatatgtatatatattatatatgtgtatatattatatatatgtgtgtatatgtatatacacacacacatacatatatacatattccttaataaaaaaaaatcccaaattggaaacatttttggtccaagcattttggctaagggatactcatattttaatatcctattttcatctgtcaaggcagcaaagattttaaaactgtaattttcagggttgcagacaatgtagtaaaagggtgttctcatagactatgagagggcattcgaagtagtattataaaaccctttctgttactttttatttccataggtttttggggaacaggtggtgtttggttacatgaataagttctttagtgatgatttctgagatttgggtgcacccatcatctgagcaatatacactgtacccaatttatagtcctttatccctcacactcccctctcctcacctccccgcatcccgaaagttgattgtgtcattcttatgcctttgcatcctcatagcttagctagctcccatttatgagtgagaaaatagtgatgtttggttttccattcctgagttacttcatgaagtagtaaaactcttttaaaaagcagtttagcaacaagcaccaaaattctgtgtttgggaatctatcatgaggaaacaatactagctgtagagaggtgaaaactgcataccaagacactcacttcagcattgttcacaataatggtaaaattgaaaactacctaaattccttaagttaggggaatggttaagtcgtttatggtataatcttttgatgaaatattttcagtaataacttgaaagtcttttttttaataatattgaactttaaaaaaggtagagaattgaatatcttgtatctagaatttaagggagaattaatcctgtgcagcataagaagtttattagaatgttaacaatgtgtatcttaggatagcaggactttagtttttttccccagtttcctgttttttctctgtttttcaaatgtcgtaaaattggtatgtattacctttataataaaaggaagcctacttaaaatggtgggattaatttaacacattctcgaatataacttcagatgtcatactaattcagatatgctcaactcatgctctacctatcagtttatactttagaaaaacatgatacttagcaactgataagctcacttagatgatctaaatattctgtggtttgactccatctttgtttcagagtgaagtttattgacttttctttctaatgaaagtgtgtcactttcttcttttttttattccctttacttttggcttacgtctaacctccagaaaagtgatgtcacattttttttagcaaaccagcatcttaaatgtgtaatccccattttccttcccagtttcataaggttaaatagcttatatctgctctgttactatttttatattctgatttgcttttttttgttttgattaatacttcttcccctcatttttaaggttattctggtacaagttaacccaggagaagcatttacaataagaagagaagatggacagtttcagtgcattacaggtaagaatggtaattgagaataatcatttgagaccaaataaaccccaaaaatttatgatacataatagtgtatatgcctatggtttcttccttctttctcactaccagcacacaaaagcataaactctgatatcttagcatttaagtattgcagtgtcattctaactagtctctttgccctggtttcctgattatgttgattattcttgatatattatattgttcatgtctctttcctgttcagcaatctttatcaaatctagtccaggtgtcttagtttttcagaaagatcatttcagctttttagtcttgttcccacttccccttcaaattgcttttcttcagtttttctaataggcttattcactgtcttttgaagctatcttgtactatgtgttctgtttcccttatctggaattcacccttatcaccactgccccccccacccccacccccaccccccctttcagatcctacctgtgcttcaagactgagctccagtcctacctttaacaggttttttggaaagtctttgtttagtgagcatctccttagtactgttgacttttgggtcaggcagttctttggtcagcgggactgttctgtgaactgtagggtgtttagtggaattcctagtttatacctactagccactcaccctcacttattcatttatgacaaacagaaaagtctctggatatccccaaatattccctgagggacaaaattggctccagttgagaaccatcttcctatgggaagatgagagcaataaaaaagatgactggctttggaattagagagagagaacctaggattaaatcccagctcctctgctgtttactagctacatgaccttgtacatgttacttaacctctgtaagtactttttttttttgagacagaatctcactctgtcacccaggctggagtgcagtggctcaatcttagctcattgcaacctctgcctcccgggttcaagtgattctcctgcctcagcctcccaagtggctgggattacaggtgcctgccaccacgcctggctaatttttgtacttttagtagagatggggtttcaccatgttggccaggctggtcttgaattcctgacctcaggtgatccgcccacctcagcctcccaaagtgctgggattacagacgtgagcctctgtacccagctctcggtgagtacatttctcatcattaaaattcttattcctgtcaataatagtacaccttataggatcattgtgaaggttcctgatacacgggtaatgtactctaaaccagcctgggacatacaaggcactcaataagtggtggtgagtgctgtagtgttattgttaatagaaagtgatccccgtcacctgtgaaaccccatcataccaattattgcaccattcatttaccaaataactacaccatcttgtaatatttcttctagttgtatttttaaagttatttaaattttgtattgtttaacataaaatttttattcagtctccccagctaaagtctaagcactttggggacacataccatttcttacatttctttgtatccccttcaattcttggccttccatatgttgggtatttaactaatagttattgctttagtttaaaaagggaagacaagtgcagtgggtcacacctgtaatcccagtgctttgagagaatgaggcaggaggacctcttgaggccaggaatacgagaccagcctgggcagcataacaagaccctgtctctacaaaaaatttaaaaattaggcatagtggcgcacgcctgctgtcctaactactcgagagataaggttggaagattgcttgagcccaaaaatttgaggctgcagtgagctatggtcataccagtgcactccagcctgggcgataaagcgagaccctgtctcaaaataaaattaaatttaaaaagagcattggagatgaggtgtctgtatactttgtcatctttcaaactggaatacagtgaaagaactctaacacttacttcaagacaactgatgtaaagcaagactgtctagcccaggcaaacttcctgtcttcccccattttacctaggctgtccaatctgtttaatcaaagaagaaatagacctaactcttttcagagaagtaatcagctcagtaattaaaattaaaacttttagcctgacatttaaaccttatatatctgagagttaaaaatttctctctaagttgaacacatggacacagagaggggaacctcacacaccagggcctgcgacaggccccgggccaaggggagggagagcattaggacaaatacctaatgcatgcagggcttaaaacctaggtaatgggtttataggtgcaccaaaccaccatggcacatgtataccgatgtaacaaacctgcacattctgcacatgtatcccacaacttaaagtaaaaattttttaaaaatttctctaagttaatttaaatcatttgtgcagcagttatggcaatttcacaaataggaagagttcacatattatacttaaaagaaaccaggcagtagaatttataagcagtgtgataagcattacctgtctttacttgccagttaagtttttatgaaaataattttattctgtgtacttcatagagtgtaagtttctaatagagcacacatctaggtttgtacatctcttttcaaattgttttcaataaatactgtttatggtgggtacattttaactaatacagcattgatcttttctaacacatttgcagaggaagatactcattactgttttagtgtgactcagaacacaaaaagtgctatttatgattggataaccagaccctgaattataagtagcttatatttcaaaagttaatttgtaactgcaatctgtaaaccccacctccataaatcaattaaattgattttatatgcggcagtgacccctttggtcaggaccaaaaaagcctatctaatttataatgtgcctgtaatactaacagtatcttagtgataggaactaactaccatgagaagatatttttaggcagggacacatttctctgcttcagtgggaaatggattcctttctctatatgacagattgtaagattggagactgttttaaaattattgggtagaggttttaaaaacacaggaaaggataaagggaaccagacagaaaataagaaggctctcccctctttatgtttttgactgtccaaaattacaagatggaatatgggtggaaggaatagtagtgagcaagggaactggggttgaagtctttgtaaaatcaacatgccttcactctgagcaagagaagacaagaaaagacttctggagttcattttcttccacttagccatcactagtttctgtcatatggcaagccccttcgtggactagctctggatctaggcaaaaagtgagattattaatagaagtggaggcaacagataacaaggagaaagagaaattaagggaagaaaatcatatgccagcgaagtggagagaaacatagatcattatagccctaaggccatcaagttaggaaagctgttctctgacagccactatactaataaaatctctatattaaaacctaatgaattgagataagagctgtgtaaattaataagcatttgaattaaagtccattcttttaaaagtagctttattacttgttcagaatatttagaaatgaaaactaggttgagaatcacagagaactttagacatctaaataattaccttactttattggaggctcagattttgtgagttacagctagttatgggcagagttcaatacagtagtttttctactgtatagcatacattctggaaagacaaattgctaattatttttttctatgaattttctaagtatctactgaggtatactgtgctagttgctggacattcaaacaaaatctgaaaactaagttcctgacattcaagaacagtgtcatgggggaaaaaaagggaaaattaacagttgtattacagtataaaaagagatacacatagggtgttatgggagcatagaaggagggttactataacattcagtggtatgtaaagaaaaaattattccaggagaaaatgacacatgagcctcctcgaagaacagtggcagttggtcagatggacaaagggtctcaaggcactttagacagagggaaagtgttcaaaagcaacagaaggaaagaatgacttgacttatttgaataaccacaaagagattggaattgctaaaaagttgtgtaaatatgtggtacctgttgaaccaaaagtcttcctactacaaacatcattggaaatgttcaataaaataataacatgtaatctttcaaatacactcctgagcttctctctcttcccttcaccctataaaaaggaaaaaaaaggtggggactggggaagaatcactgtgggccagaaacaaggacttttccacatttatttgtcttctattttaagagacagggtctctttgtcacccaggctggagtgtagtagcacagtcatagctcattgcagcctcaaactcctgggctcaggtgatcctcctgccttagcctcctgagcagttaggactgcaggtgcatgccaccatgcttttatagagttgagttctcactgtgttgcccaggatgctctcaaactcctgggctcaagcaatcgtcccatctcagcctcccaaagcactgtgattacaggcatggacaattgtacctggcccaatatttgtttcaaaaaatacagttttcatatttttaatgaaaagaattaaaaatatctacattgttcttttgatttgatcattttctattgtcccataccattttttctgagtcctcttcagaatttgatgtctgtcttcccttagttctttaccttatttcatgtccttttggataaggcaccactcttaaatatctaaaagtgtagtcttctgttttgctagttttccattttggtcattggttagatctgtttatatttcctgatatgaacccatacctcattttttcccccttctttaaccattattcactggttttaacttaaattcttgattacttttgaaatgagtgctagtttgagtctgtctcaggttttttctgttgagaggtattttgaaacaatctaacttgttcttacgttttcatagtgaagtgctttgatagcatgtcaacagattgtcttgtatattgagagatactgtgaaaattaagtattttgcctagtaactggtatgtagaaatgtaaaaatttattgaatggggagattttaggttttatattaatagatctttgtagcatgtgctaaagactaccttcttagttttatgttgtgaagagttatgaaaaatagggaattaggcaaggtttctaaatttgggttactgggaaggtcatagaagcatatttcatagagaatatgtagtaaacacttaagaatcctgtgtagagctggctctcctgatgacaaattggttcctctagatatcatctgttctgtgaagcccttgctttagtttctctcctcttttagctgtagatacacatacagaaataattgaaggcagatatttttacatatgtttatagccctgatgctttgtatggcacccagcacatagagactctcaataaacgtttaaggtgagtgaagaagagaaaacaacagatgtttcttgagcatttatatgtgtcaaacaagtagatgtgttatagccaacagttgtagctaaaaaccctccttatgagaggcaggtatggctttttctcttttcgtctgtgatacctcagaatgaataaatggggctaacgagtaagaatttattaactatctaggggttttgcattgttatggcacttctactttggtgtgattccatgccactacatgtaagagagaaaattatgaaaagcaaaaaatacacagacgagctatgcttgaataatttttatatgctctggctccttcaaatattatgttttagacagacaagcaaaaatattgatgattatttaatactttaatagggcagtagttaagcagaagggtacttgggtttgagttcaaactttgccacttactattgtatcagtcagattatattcagtatatattgtgtcttacacttgtttatgtaaatagtgtgtgtccgtgtgtatacacatcatgtaggacttagaacataattttgtcatagagaagattattattaggccgtatcttttgggatatattacttatatctgtggaaccatagaacccaagacctacatcatatatagtctctaattacattgatcatggattaaccacatctacattataatttttctgcaaagtggcttctacaaaaacaaagaccttatattcttcatccattcacttattcagtattcagtgagggacaaaaatgaataagcactgtttattttctcaagcttatttgtcagactttcttatatacctttataggaagatgaaataaaatttgatcatcagaccgttgccagtctgcaactttgtctcacgttgtgttactcaggattttgttctctagggctttcttttgagcctgttaaatcagtacctttttttttttttttaacaaaaataaaaacatgtttatgaaatgtttaagtgtcagaaagttgctaacgttaataaatgtcaaactcaagaagatcagaacatattgaaatgataggtcaaaaacagtaggataggcccagcacggtggctcacgcctgtaatcccagcactttgggaggccgaggtggggcggatcacctgtggtcaggagttcgagaccagttggaccaacatgatgaaaccctgtctctattaaaaatacaaaaattagctggatgtggtggcgcaaacctgtaatcccagctattcgggaggcagaggcaggagaatcacttggacccgggaagcagaggttgcagtgagctgagatcctgccactgcactccagcctgggtgacagagtaagactccatctcaaaaacaaaaaaacccaacaggataaaatttaataggagtaaatataaagttctacgttttgattttaaaaatctaggtactgtatagtgtgtattagttggggttccttttttgaaacttaatcttgcctataaaacacaaaagagtttaagatgatattgagactcctcctgtcctcattccttttccttcctaatagctcagtcctgaagctcttaggtgaggcagaacaatataggcagtgcactagtgggaatgggagaggtgagctgcagttccccagagtaggatgtcagagccctaattgaatgagaaccatatcacatcagagaatagccaagtatagggagttagagcccaagcagactgaagagggaattcacacaagaaggcagcctggtatagggagtcagagtataaggctgaggaggatatcatcaagaaggtatgtagtgtggcatgtaagaacttgagcaggatgaggcagtcactgacgcaatgcaatgatccagcatggggaatcagagctcaaacaagagtgaggaggccatctgtgtggaggggtagcctgacctgggttgtaggagtcccagcatggtcagatagtgcacaatctggggatgtattagagtgaagagtcagagcccaactagggtaaaaagggcatccacacagaggtggtctaattaggaagtcatcatcaatgctgtgattataccccttcccctcctccactaagaactcagtattacttgcttctagcacagataccacttctgcaacaggaattttgtagccacccaccactgcctgccaaattatcagcacctgtaggagtgatggtctttatctcacaccaaggagactcctcaaacacacaaagggacttcagattctatgcactaaaacaaatgacagcgtccactgcagtgcaagagaagacaactttatgaatagaacttgcttattttagcggaactagaactaaatatgagtcatctattgaatcccatttgcaaaagggaaaacaaatgaaatcttggacttcaaaaatagaaatgcaagttcaaaacagatggtggtgtatgctggttagacggtattcttttaacatgtttaaaagaagtattgacaaactgggattgtcccaaggaagataaccaggagatcatagaagcgtgaaatcacctttataaaacactatagaaatgcgtgaaggatgtttaacctagaaaagagggcagtgacttggtctcaagctcttgacctcgtgatccacccgcctcggcctcccaaagtgctgggattacggttgcattcaccaccatgcccggctaaggaagcagattttgacacggggaagaacagctatggctgtataaaaatggagttgtttgttataacagtgtcccatcttcatatgtgttcataccctggttgggtgatattataaaagtaattccagcatagaaagataattgtgattaggtgaattccagcagttattgtaactaaagatgctttgattccagaataatctgtttattaaactgagttctctttagttacttctgggaatgaggactctgaatgagcgtgttaaatttaacaagtctatctgtgcacaggcacataaggtaattgagctagtgaatggttattgctcatggtagacctataaatagtatatcaactagttaatttattaatacccactactggtgaaataaatacttgaggagagagaaacttccactacattctgaatctcataggggcaggaacaataatgccgtctttattttggtacaaaaaccctacttaactgaagtggagtattatcttccattttgtttctttaacaacagaaattgcctgtttcatcttttatcatctgtgctaaaataatgccttttgcttagtgggcattctgtcaatatgttaaaaagaactgctaaaatatttttatttgtgtacagtacttgcttgccttggtaactgttatataccaaaaatatacttttcatacttggggatattttagtgcctcagagttttcaatatgagcaccatttaagattatacagttatatgaaaatattgatttaaatatgtaaatggtgagccacagatatcacctgggtgatgatcatttgaccaaaaattctgggtttatgcttattttctcatgatttgactctttgtgtagaaaaagtatcaaggtgaattcaagttttctgagaggtatcacctttgttttctcatacctcacgctgcttggggaagacaagaacctaattaacactactagagtgtgttgattgtgaacctcgtcacctactagagttagtatgatcaggctccacctagaagtcctattgctaaccttttggtttcaagtggctcagaacagcttctcaggagttattgatgttttctcctcgttgttgctggtatggctttttctgccagtaggggtttatcctttcttgcttctactgtcccctcattaaagaagtaaccagccccggtgcttctgggggcagttattgtcaactcctctatctgacttttctttttcgttgctgctgctgttcattgcttttctactctcacctcatttcctcaagtacctgatcctgcttcttcctgccattacaggtctttttgaacataagggatggtatgtcccaaccagttagtaaccattttctccctttctgtgctgtgggatcgtgatgattataaccacacgtccatcctcattcctgcaattagtcagctttttcaaatacctgccatctcctttgcagagcattttttagcaagtccctagactaagccagtattttgttaaatagttataaaccctgagcctctatcccattaatcacaactctgttacctcatggtaagttatttgccttgcaaaagttggagctcctggccttgtccttctctcatgttctagtgtaaatccttatgcccataagacataagcaaagccctcttctctcaggatgtctttgttggggaggagagaggaatgtagagtcctcatgcaagtaagactcctagtaacctgctctgatatcctggaatctctgagacacctcagcctcatgactcttgatacttcagggctttgatattagaaatacctctgaaatttatcagaagttgtgtctattgtgttgtagatcatagtcactacaacttttgctgcagttactataacagtaggcatgagatattacacgtataccatttcttcctataatcacaataaaactttaaagaagtaacagactatgtgacagaattaatggtgtgttattaaaggcacaggtctgggagtaaattgacctgggttctagaaccaatgggtggaagttaaaagaaaacagagtttagcttagcatgaagaagaactttgtaataaacggagatgtcaaaggagggttaggagtgatcagtttcccatccatccttttttttttttttttttccccttgagaccaagtcttactgtcttgcccaggctggagtgcaatggcccgatctcggctcactgcaacctctgcctcctgagttcaagtgattctcctgcttcaacctcccaagtagctgggattacaggcacttgccatcatgcccggctaatttttgtatttttgtagagacaaggtttcaccatgttggccaggctggtcttgaactcctgatctcaggtgatccacccgcctcagcctcctaaagttctgggattacaggcatgagccactgcacccagcctctcccatctatctttgtaggtggtaatgcatctgctggctcttcacttgatggtggtttatttatagaagatggtttatttcttttgaggggattgttcatgccttttaaggttcatcacaagcctaaaatgctattaatttatagccgtaggtaatttacttaaattctggccggtattgtgcatatactgaaatgagggtgggctagggcaatttagattctacaagtttctaccagctctcaaatagttacatattcataactatactaattacataccatgtcttaaatgtattttaataatacggagattgatattataagaattttttataagatcactggttatcttttgcccactgactttgcattacagcaaatcagaccaagttctactgaaattataagtaactcaagtcaaaaccacatgtagtagatttttattcccatatgactatttacttttttcataattagcaaactaaaccatggagaagtttgttctttatacattacttaaacaaccttaacttccattagaaaattttttgaagcataggtaactatttttcatactggtggaaatcatgattgtatttaaaaatttgctctttatacttccccttttaatatgaaaacatcagtttaattagagtcgctcaaaatagtagctttgaaacattaatgagtcatgtttgtaaaaatgaattataacagatcatccattcataaattcagcccatttcaatttaagtgaatgactatgattcattccgagtacattgtgtaatagtctcaggatgtcccagagagctattaaatgttacttttcaagagaaagtgtgttatataagacttatttaagagaaaattgcaatatttttgttagaaaggaaaatatagggaaattcagttgtcatcaattcttcatgttcctaataagcaaaatatcactgttatagttagtctcttggaagtataaaatctaagccagtttagtgagtgctattaaaataagcaacaaaaatattgattaaaaaaattttttaatgactgatgacaaaaggaaattaggatccagaaagatgagtatgtgaaatatcttatattagcttttgaataaatgttcacaaaccttttgcattctggcacttttgatatcgtttagtgactaaaatggacataaaaggatctaagccttcttttgagctggcctcacaaaatgctattttattacgtaggtagaaatatgaatataaaatgtttgttttgtgtgccattctctcttcctgttttcccttttaggaaaaaagccacttactaatagtagataagagctaggaaatgaggctagagaagcaaattgacttggaatagggaaaaaatggaaagattagataattttaaagacaagaaaaatgaatttggatgttttacaagagtcaaaaatttacagtcaaaagagctagagaagattttcactttaggcagattttaagctaattcctaagaattatgtatctaaggcagtttccatttagtttgattttaaaagctgccttttgaatatctaataccaattataaaataaatatgtgtaagtaaaataaaatggtaacttgttttttataagaggggaagttggttggttttataaattaaatgaacatttatgcagtcggttatttttacgtaaaaatagttgttatattctaggtaacagaaatttagaaacctatttttctgtagaagaaaggtgttgctatctgcttttgatttctcagatatttgcttctccttagaatgctatgatcagatttttattagaatgaagttttctaaaggctttgattggcattagcttcattacttatttgcttaggttaagattagcccaatagacatattatctttatggaccattgcaaatttttctaatatctaaccatttttaaccttttatatatgaataattaaggaaacattcaattataataaaatttattcctggcactatgtaggcactcaataagtatttgttaattgagtaaatgatcccagtagatagttacatacaatatacagggaatctttttctactacgtgtgtttttcctcaaaatatttttttagttccacttcatcatgaaattacttggaaactgacaccaaagagatcatgtttgggcacagttttatttcactcagcttcactccaaaattctcatactatgggaaaataatccataacagtagtaactattgtgatcatatactactactacttctagattgaatgattgttacactcttgtcaaggtcaccagtaacctctgtgtagccagaatgagtggtcaattctcacttctcatcatacttgacctcagtgtattatttgaaccagtagcattcgacccagtatatttaacccagtgtattatttccttcttcttggacactgttctcttgattgcccttctacagtttatgcattctcctgttttttttccaaccgcactagtacttccttctcagtctttttttcttttttttcttttttaagtaaagacagggtctcgctatgttgcccaggctggtcttgaactcgtagcctcaagtgattctcctgccttggcctcctaaagtgctaggatttacaggcatgaggcactgcacacagcagtgttttctgatgtgtattaaaatttaatttcaaaagtatgtagcagttaagtgaaataaatcagtcacaaaaagataaatattgtgtgattccacttacgtgaggtatccaaaatagtcaaattcatagagagagaaaatagaatagtggttgctagggactagagggagggaagagtggagagttagtatttaatgggtacagaattttagttttggaagatgaaaaatgttctggagttggatagtggtgatagttgcacaacaatgtaaatgtacctaatattgaaccatacacttaaaatgtgttaaaatggcaagttttatctgtattttaccacaatttaaaaaattaatttagtaaatttttatatttatcaaaaaccatttttaaagcagcagatacctgaagccagagcttaaataatgtggtaggcaaaattctaggatggcccccagtgttgttgccttctcttgtacataacctacataatttccaggacaatgaatatgatgaatgttactttcacaattgggttatattgtattgcatggtacagatgacttttaagaaagagagattgtctggaataaacctcactaatcaagtgagtccttatgaaaagagggcctttctggaagagatttgaagcatgagatggaagtcagcaagtgaaagagttttcttgctggctttgaagatggaaagggccacatggcaagaaatgtgggtgggctctgggaactgactgtggtccctggctacccaccagaaatggggacctcagtcctgcaatcacaaaacttaattctgccacaccataagcttttggtaagaggtctccaacctccagatgagaatacaccctagttcacgcttctttttttgccttatgagaccccgaacagagaagccagttacaccatacccagacttctgaagtacaaaactgaactaatgaatgggtactttttaaaaccactgtttgttacacagcaataaaaaactaagacaaataatatgaacttttttcttttctcataaattacggtacaaagataggcagttagtgcttgtatggaggtgctgctccataggttatacaagtggcctaggttacttttgccttggcctgccatccctaggttgctgccaatgtatgcatgatccaggttggctcaccaccatgtccatgtgccaaagagaatggaaaagggcaggagaagaaaaagagatgagaaatttgcccactttctttaagaacatatcccagaggccagacgcgctggctcacacctgtaatcccagcactttgggaggctgaggtgggcagatcacgaagtcaggggttcgagaccagcctgaccaacatggtgaaaccctgtctctactaaaatatacaaaaattagctgggcatggtggcatgtgcctgtagtcccagctagtcaggaggctgagagaggagaatcacttgaggtagaagttgcagtgagccaagatcacgccactgcactccagcctgggtgacagagcgagactccgtctcaaaaacaaaacaaaacaaaaaaacaaacacatccaggagattgcacagatcgggggtctgtgctttgacctctgactggggtctgtgctttgacctctgactgctgcttctgtcacagacatgcaaacaaagaagtgggcagccattgttattgtacgaccctctattgcaagtgcccccccaccccaccccctggctgttgtgacttccaggggatttaaagaacaacacccttttatcccccactttgttttcccccgtctgggagccatgcattaaagattaggtcagtcaacatgtaccataggccaggctcagtggctcatgcctgtaatcacgacactttgggaggccaaggtaggaggatcgtttgaggccaggagttcaagacaacacagtgagacctcatctctactactgaaaattttttaaaaattaggcatggtggtgtatgcctgtagtcccagctactcggaaggctgaggcagcaggattgcttgagcccaggagttcaaggttgcagtgagctatgcttgtgctgttgcactccagcctgggcaacatagcaagactctgtctcaaatctgcttttacagggaaaactgaaaatgaccatacatgctcagggaaagacataggctctcagaagaccttaaatgtacatctcaggctgatccttggcaaagagatagtctacaacaataaaaaaatcagaacaataacaaaaaacagccaactctggggaaagagaagaaactgatttccagagtttctacatgattagatttaaatgtccagttttcaacaaaaaaagattacaaggcatacaaagaaacagaaaagtattgcccattcaaaggaaaaaaaaagaaataaacagaaattgttcatgaaaaaagactcagtggtagatctactaaatacagacttaaaaaaaaaaaaacaactcctggggctgtgaaagaaaacagagactttaaaacaactctcttaaagatgctcagaggaatgaagtccctgaccatccagctaaaccattgggtacagcccatgaatctgtatgtaatcacacatctggccatttctacttccatgcagagtacacaaccagttgcactgcttgaagttctgcccactgggaagatttcccttcactgttgtccttcaagaatgtcctagaaagggactgtagtgctgcagctgttcacttttgggtgatgcctgcatatcatgcagatccatttgtgaaccaggccctatcttctcttcctgtgtcaactgatcatagggaactctccatgaggccataggtgcaggctgggggagagaaggcagggtggcaggagtggagactatgggcatttgagccacttcctcatgtaacttacttgtgcctgcaagacctgctcaagctcgatcacttccatttgatgatggaatgctgccatgcataaaccactttatggctagatgggtcagaaagcacccagttcatgatgggcagttaggtcacatggtgacttgatgacccatagtcaaatattcagtttccaccaaagcccagtaacgggccaagagctgtctctccaaaggagagttgttatctgcggaagatggcagggccttgccccaaaatcctagaggtctttgctgtgattcacctatgggggcctgccaaaggctccaaacagcatccctatctgccactgacacctcaagcaccattggatctgctgggtcatatgccccaagtgacagagcagcttgcacagcagcctggacctgttgcagagctttctcctgttctggagcccacttaaactggcagcctttcaggtcactcgataaatgggctgaagtaacatacccagatgaggaatgtgttgcctccaaaatccagttaggcccactaggcattgtgcctctttcttggttgtaggaggggccaaatgcagcaacttatccttcaccttaggaggaatgtctcaacagtctctctttttccatttttctgccttcttatcttctagcggtattggcagctgattaggttgtgcccatccagattaaggttaggtctgcctttcccagcccactaactcaaatcctttggcaaccctcacagacatacccaggatcagtactttgtatccttcaatccaatcaagttgacactcagtattaatcatcacaccgccttcatacctttgttcacattgttccttcttataaaaatcacacaggagcatgcatacatacaggtgagagctttctgaatctttccagcccttcaaaacccaatactagttacatctattttgagactctttctgaccactccaatgttaaaaaaaaaaaaaagtgctccttaatttcttgtaatatatatattgtcaggcttatatctctaatctggcatgttgtttattggtctatattgttatttgtcttttttttctgtctcagagtccatctttaataatgtaattaggtgctcattgtctgccaagattgtgttgtatgcattgattgcattaatcaactttaaatcttaagagaggaacctgagattcataaaaagcctcatacctagttattggtggatctagaacccaaatgaaagtctttttgatttctaaagaataatttttacctgcaccaagatatcttagaatcaactggggagtttaaacatacagttgtgtaggcccacatcagcctttctcaactgatttatgatacaaaaccatgatacagtggtagtatactctttgtaggctacattcccctccgctctcctccccgtagcacttacaactgccccatacatacagaaattcagtaaatgtttatttacttattttaggcatataacaatagaattgtctttatttcagcacttagtcatttctaattgcacagatattgccttatagatcctcaagtaatgaaaaaagggagagaaagtgactttgttatttaattagcatatatattagctaatggttatcgaacgatccctgtaccagttagtgttgtaaacactctacatgtgactaacctattcagtcctcccagcaaccctttcagctaactattatcttcattttatatacgaagaaattgagacacaggttaataattcgcctgtagttaccagttactgaatgactcagctgcgacctgaactcaggcagtctggctgcagagtgcatacttctaacagttaccttacagtgacttctcaaacatagagtacctaagatggtgctctactcatagtccaacaatgattagttcctccaaaccatgtacttgcttcctgaaatatttaatatatttcaaaattgaatgctgaaaccaaattattataccaaatactctactcataaatttatctttgaacctcaagactatctctatcaaaaagtgccatttagctttacatgatttatattgcatgatgctggggcaaacagagtctcttttggttttaattgcaagatgtagtttttcctcagagcattgagagaacatgttttatttcctttactaatcctctgttttgaggagtgattcactgaaataattttaaagagtgaacgatacagattttatattaaacaaaacactgagtatgagagtttgaaaaaggctctttcttcatttatacctaagaaataccttaattttgattaccctaaatggcagaggtggggtggggtgactaatatcatttgattctacttttttggaaagaaatcttcatcaattggttttaagatatttttgctaaagatgatattattagagttaataacaataggcgtaaaaggtgtgtgctttaaaccttaacctaagcacagagtgtccttgtaaaatacctttctgattaactgaaaaccagaaggcttttccaattcattttactgaaaatatttatagaataacaaattcagccatggtaagcagaatatactgaaaataattcagtctttcagtgccctaaatcattgtaagtattaataatactgattgtactatatagttgtagattatgtagaagatagagttgaatctagattagaatatggcctgggggttgctttttaaacccattactttatgtaaataattcttaacctaatatttgcaatcactattccaaaacactggagatgtagtgataagcaacatagactgtatccctgactcccatgaagtttacagtttcctaggaaagaagatttaaggaattcgatgaagtgagagaagtgttgtgattgaaaaagaaaaagaaaaggcactatggaagcatatagcaagagcattcaaaccaatccagggactagaaaatacttccaagaggacacttacagggtgagcctactctattctttttctctcaaaaatggaagattaaaaagttttattaattaggtgtttgctttaatcaggaccatttatttgatatatattattaaggatttcaacaaaattaactcttttgtaataagaaaaaacattacttttgcatggaaaatacagatccatggaaaataattgtggcatatttcctccaagtatatggtaggattataggaggtttttcttctttatactttacatataatttgataatgtcaacatgaatttcataaataattatacaagtgaagttttaaccccttttaaattgtttagtccaactttatttaaaaatgtatatatatttttttaaattaagaccctaagctcattcaggaaagtgagataccatggtgtttttggtgcagataagtggatttttaaactagtaaaaactaaaaaatcagacatatgaaggttatcaacacatcattgtagtccatcagttttctaaaaatcaagggagtggaagaaaagaaatgtctaaatttcatatcataatatagaactgggttaaaggattctgccactcgggatagataagaaacccgctggtccaaatgcagtggtgtttacaactaattgatcacatcccgttatggatttctttgtttcctttccactcccactgcttcacttgactagcctaagaaaataaaataaaatataaaggaaactcaaggtagagaatctttataccttgaggatttattttcttaacactatgaaagaatgtctagaaaggtcaccttccttattaaaaataaaaaccatactctccaaagttagcttcattagaaggatatcctggtgagaaggacaactgaatcacaaacacagagatttaccttagtttagccttgtagtaacttctaccacattttttgattcagggaagtactaattaagcattctaacccaggggcaaacctttgtaatttttttccaggagcatacctgagatgaggctaggatgtccagagaatacttatataacgttataaagaaactaccgtgcatttatctactgtcatttacatgcttttgtaccatctgcagaaaatgttctaggaaacagaaaagatctttcctggttcctttgtttgtatggcagcatgttggatgtgatttttagacactacctagatatatagagatagaaaaatcattctcctccaacttatctaggattcattctctaagttttcctctgttatggcaacaaacactttaagcataatttcatttttcagaaagtttcttcctgtatctagagaagtgtgacttgtgctcctgactgtggttatggtctttgattaaagtgcatccaaacatgtcaccattaaccataagaatcacaaaataacataatggttgcaggacaggatttctttacaggtatgttattttctctatggctccagaggttaaaattatgactctaccagagttgagtagagttagcattggattctctgatcccaaaacccatgtgataccattgtttgaagatgttcattcacttttaaagaatgaattttaatcaaatccagtttccattctttatggtttaacagagttctgtctttgacattcccttttgctttatcatgtaatccttcgatatttttggaaaatcctttcatcattacagtaaaataccatcatatttcaatattttaatattatttttagtcttaatgtgctgaagtttctcacttcttttgtgtccagtcttctgtattcagccacttgctagaacacagaaaacacagtcactgaatgtgtgctcttttccctagagagagaatttgttttaagtgccttttcatgtcctgaggggcaactcattcttgacagttatttgaaagacttaggccttgcctcacagcctagtacaacagacagaaaagtaacccacagttaaaacaaagaaggccatgctaagtgctatgatggagtttatgtgggaggccagggtaggaatacctgagcaagcatagggaagtcattgagtgcttaggaaaatatgatgcttgaagaagtagaagttagccagaagaaaaaaataaatagaaaagtatcttcgagacagaaggaacagcatgtgcaaagcccaagcacacacagattagaggaaacggaaaaactgtgattagagaggtagcttagagaagagactgcatgggagagtatctgaaaatgagactaaaaatatatgctactttgcaagtaccgttatatgccacgctagagatttcacattttattctgaaaggaaagggaaccattgaaggattttaagcaggggataaccaaaactatagtaataagaatgagacctggaagctcagtgtggagggtgagaagaaactaggatgatttacaaatttcacagacaagaagaactatgagaacaactgtctcagcagtttttatattttccaaatatttcttttagatgattagcagttaaaaaaaaaaaaaacttagaatgagggaaagcccttgcttttttacattttttttttaaacactttttcttaagaaacaacactggttgaggaaacgccaccaaagcaaaagcctgagggtatgggaaaaggcccttggcatgttttcatgttagtctatgtcagagtaatgatgacagaatgaaaggttattagatgtgcctccagctttgatctctgtttggttttccagttcccctgggaagtgccagtcttacaacataaactaacaggaagggtaatgctttaagtgtacaggcctagtttctttttgggagaacctacagcaggatgtgaacattctgtgccaagcctccaggggtaagttctgttccttttatagaagagaagatttccaattaggtgtgggtgtgttttcagggataatatatttcgaaaccttatacatatgattactcataagccatccagctgtaaccattaaaaaattgatattttgatgcccgaaaagactaataaagttttaaaattataggcccaaagaagaagtgactattgggaagaagacctgaaattacagtaaattgtaaggccatagtgtagtgctccaaatctgaatcaaagtgatattttgtcaagcacagcatattatataaaatgcttaataaatggcaacatatctgcagaagatagtctaaaaagcctagatacagaagcctttttacagataattcagatggctagtagaaccttaagacatgtttctaagggcccagaccttaaagcacagaagctgtgaggaaactaacatatagattctgttgtatgggcaatctataattaaaataaaaaagtttagatattatgtaaaaagagaacctagcacaaccctttttgacactagcagtactgatttaatgcagtctgcatggtagatgactagcctgctttgtcacttgagcagtttttttcagtctgtggccttaatgtttgatcctgacaggatttgcgtcactgatccatatcactgccgtgtgatgtcaaagtgtgggtgttcagttattgaggcatagttaacctaatgtgctgcagtaaatcctaagtgctccttcctactaaaataacaaaagaatgattcatcattgttcatattaggctgatactaaaaatagtaatgttcacaacctgctgcattcatggacattaatatcacagcctctgcagctttctaaacaagtgcactaaaaataatttcttgtttagaaacaggtgcttggtaaacacatctccttcaagttttctatttatatgcagttcaatttagtgctaaaggtagattctaaccataagtcattcttcaaatgtactctacttagtgtttatcactgatacatctaattgtgctgcaaatctaatcatagaaattttcagttacttgtacacagataatgaaattatccacaattctgaatcatacttaggcccctaatttaagcattctgctttatccaaactttaaaaagaataataaatttccaaggaaaagaaaggtctctaaacatctaagcatgaataatgaccttgatcttttctctttctcctgtaacttccttattctgttcccaagttctgactcaccaatttggtgagttcctagatcaaggcttacactaattgcctgccttatatgaataaatgttgctaggtgtttcatagccttaataaataagcattccttattagtaaggggaccttatatcccaatttgtctaagacagttctggtttttgcctcatcttgatatctaactggtatgacatttgtcttggatttatcatttttaaaacaatattattagtagttcattaaaataagttgtgatagatttggttgaccaccattttgaatttccagcttccaccttgatctctagtaagtagctcatctgtctctttttcactttaaacttgtggttaaatcttagacaacccaaaataaatcattctctcttcctgacccttgccagaagcaagtcttaattaacagtaagtgaaagtgtgcttagatttaaaggactgggaactaactcctttcagtttcctggtagtagtggcagaagtatttgatgctgctgtctttgctggccacttggtgtcaccagggcaccaagtggaaggaccagtgggaagcatataggttaaataaataaatatgaggaaattaaatatttctgccactgaatatataaaaaatagcttgaatgatttttatcacttattgtattgtgtataactgttacttggcagtacttttttatcttgcagtaaactctctcagcaataatgagctcaaaaacaaggtctaaatttggtgaaacatgcagaagaaaaataaagacgattcagtgagatttgtaaaaatatgtaacatttttatagtacttaatattgtaaaaatatttgaagtatttacacatctcgataagaaacaaaaaatagaactgagagtatcctccacttagcagatatgctcccagcttaccagatagcaccttagaaacagtttttcttaatataaatgttgtagtcttaaaatattacaaaaaagagtcaattgaaggtatcagcagctttaagtttataaaccataaaatacaacattgtaagcaattttattttaaaaattaggatgactatttgaaagaagaaatttttcaattaaataccagtgataaggaattaaagacaggtatagctaagaaattaaaatacatatatactaagaataattgttccatttatattactccaatattcagatactcaatatgaagaatacctttaaatgctctttaatgtacttgcatatgttttttaataaagcattttatttttcgatagattttgttagaactttatctccctcagtgtaattaaaatatatcagtcaataaagaaacataccaaatgatgtatttttaatgatttttagccccctttttcactttcagaagtgttcttgattggatgatgataatataattatcctacctctgctctgtttcctccttcttcctgtcaccagagctcagccagcctgaaagataaatccctatccctcttacgctaagcgttattcccaaacccttttccatagatgtagggatatttcatcagtctaggaaataggaataataaagataatgtagtggtttttcattaagttaaatttatttacttaagactttttaaaaattctgaagttaaatcttttataatgtttgaagttacagtatcctctttttatgaattgatgtgacaatataggatagacttccttctatccgttcttaatttcttcttaacttttaatgtctttacttggcctaatgaaaagctggttaatgagtccccagaatttgttttgaaattttgctgtcacataaatccaaatgtttgggaaatactaacttagaacacagataacttctgtattgaccattttctggttaatatctaacctcctaaccttatccaggcaccctcacccctcaaatcaatccaaaatatatttggccttagactgatcctcacattgctttcctattagcatgtataatgtaaagtaaaacttttgttgaatcgacatcttagtataagtaaaggggaaaattatagagaaagaaatcagcgactatctggtgagatatgcaggttgattaaggcctctgaacgggataagaggtaaaacctgggtgagaaaatgagaaacagttaaaaggagaagaaacaaggtttgatttgtgcccaaggacaaaattatagtttctaattcttcactccccttatctccctttagactatttgcttatttcattgtcagtcactccctggcaatagactccttcccatggagcacctggttagttgcagatttcattgatctttccttggtccctcgactctgtggacatgtgtcaattaagctctaagctgcatgagtttaacacatattatttagatgcttattcagaacctgcactttaatactgccacaagaatcagagtcagggtcagagtcagtcttttgaaatatcagataaaaataggtagaagagtacaagagtgtacctcacatcccatccttttatatcttagtgacctgaaaccactctttgtttagctgaacgagtctaccttttaaatttttggacatgcaaatgaccctgattattataatctaacagcagccttaataaacagctgatctggtttgccaggaaaaaaaaaatcaaaatcaactcttcttttaatttgcctcatagctgacaatctctttctgcaaatcaactgattcatctgttgtagctgttcattttgcaactatattggaggacatgttgctaaaagttggacatttatggatgctttactgaattttatatatggtagaagtcatcttggactatacctgctttagttttttttttttttttttttttaagccaaatcattggaatcatgttgtatggcagtgtgggcaatacttaaactgcagaagggaagaactaacttaaccaacttaacagcgtggtccttggtacctgattttaatcatgtttcagcttacacaaagcagagagcttttattgctcatcctctagtaagagcataagactagccttcctcctttttaaatttttatgtatttatttatctcactgttttgcccaggctggtctctaactcttgggcttaagcattcctcccacctcagcctccccaaatgctgggattacaggcatgaagcaagcgtagctttttttttcttgatttttttaagcttactctttattcttattgttttttctatattaattttcccttttcttcaatttatcatggcttgtgttttggtttggttttggtgctacatatatcttaaatcaccttaaattgtcttttggaatgggttgagctactaattcactgattgttttccatataatatcccttacttactagaaacagtttaggatctttcttcacaatagtttcagtgagataaatataggtacattttgctttattatatgtaactagcagatacttagggcataatagtgttgggttttccatccaaatgtcagtgctttttgtgtgctttaggcgatattgactcctaccttcagaacccttctaagaaaacttaacaagacttaacttcatacccttactattctcccatttgccacagagttctcatcctcagtgttagtgacgtggtcactacattcaaggaccttttggttatagtgaggacaatacaggatgcttgtattttttgttccctaaagacctcattaatttgagtatatgtgtcaaacaatttttctataggaataaacacagaggatgcattgaggagattacagtttataggaatgcattatgcagtgaccagcatatttttcatttttccattcttgtttaattatatgataattttagcaaacttaaaaatgtacctgcttatttttgtaatattatctcagatattttgcagagagctatcttaatagcatggcatgtcatagcagttgtttggatttcttcataatattttaacatattaactaccattcctgaactattgattttcaggtaggcttgtcaatacaagcactagcactgtgcttaggtgacattgcttaagcacttactgtgtaccaaacactgttctaagtgctgtacaaatatgaacttatttaatctgcataatatctctatgaaatagaataattatttccagtttacatgtgagaaaactaagatacaaagaggttaagtaacttgaaaggtctcacagctataagctgtcattagaattagatgggctagctgagtccatgttcttcatcactaccttatgctgccttatgtttaagctataacaaattataataaaatgaatgataaaatagcaaaatagtaacaaaattccatttgaagacattttgatcccagtgaaaacaaatgtggttcacacagtattgacaaggatagactggtattttaccagtttgagtggcatcacccagttcatgtggaagcatagtaggctacagtaaagaatttggacttcatctcatcacaatacagaatggtctctgggttataagcagaggaggatacaatgaaatttgttttttagatcaggttagcattagtgtgagagatgtatcaattgctagggactgggggcaaggagacccattaggagaatactggaatagttctagaaagagcctagtgctgctaaggcaatagcaatggagtagaagagaacatggatttgagagatatttaggagataaaactgtcagaacttccaaatagatgatgtggaaattgagatggggggaaaatagagtctaggattattctcacatttctggcttaagattaacttatcatgggaaacacagaggcggagtgactattgatggaaaaaataactggttttgagttttatgtaaattaagtattatagatctagagctcaagaaaaagtctggatgagatacagaatgataatctttcatgagagtagtaaataagatcatcttgagagatcatgtagaataagggaagtggaccaagagcaaaactcccaggaaaataaacacttaaggaagaacagaagacaagaagccattaaagaaattgaaaaagtatgatcaggaggtagaaaggaaactaggagaaactaatatttcagatgttaaggaagaatatttaagagagttgttagcaatgttcattggatttggtaagtaagaatttcatctcagtgacttttgccagtgcagtttcagtagagtgggctggacaaaagcctgattatggtgggttgcaatgtgattttggggccgggcgcagtggctcatgcctgtaatcccagtactttgggaggccgaggtgggttgatcacgaggtcaggagatccataccatcctggctaacactgaaatcccatctctactaaaaatacaaaaaattaggcaggcatggtggcgggcgcctgtagtcccagctactcgggatgctgaggcaggagaatggcgtgaacccaggaggcagagcttgcagtgagctgagatcgcgccactgcactccagcccaggtggcccaggtgacagagtgagactacgtctcaaaaagaaaagaaaaaaaagaaaagaaaagaaatgtgattttggagacttccatttcaagtcatttggtagaatggatgctctgctctaggtaccatcctcttattaaaaaaagatcttctgtaagaattttaattgcattattgtgcccacaaaaagtaagagacatgtcctaggggatagggagcaagaaacaatgctgggacagttggttatccatttggattaaaatggaatcagatccttttctcataccttaccccaaaattaatgcttgaagacttaaagacttatgtgaaaggataaacttaaaaataataataaagagagagtatcttcatgactacagagtagagaaagtttttttaggatacaaacacacaaaatgctaactatcaaatgatcagtaaatttgactccattacaattaagaactttggtacatcataaaatatatgaaaaatataagtcataaactaggaagagtatatttgcaaccaatgtaaccgtaaggaattagtatccagaatacataaaaactcttcccaatctattttttaaaaaagactacccagtagaagaataggtgggaaacatggactgggtaatgcaaaataagatcaaagtgagattggcaaaaatttaaaaatctaaataccaagtaatggagggaatgtgaatcagtggaacttcttatacatgcctggctggtaggaatataaattaatatactcgggaaaactatgtggcactatcctataaaaactaacattcacaaaaccctaagacacagcatttcctctcttaggtacataccttaaagaaacatttgcacatgtgagctgagagacatagagatagcagcagtgttctgatccatgcttctctctaagagatagcattagattgtcttctctatctactttaattcctttgttgatgtcatccagtctcatggatttaaagcctatctaccaaagactctggaatttgtatctctagactaggtaagtatttccttgaactccagaatagtaaaatgaactgcctgctagttgaaatctccatttggatgactaatagacatttctaacgtaacatgtccaaatctgaatacctgatcatccccaaatacgcttcatccacttttgtgctattaaaattagtactgctatgaatgttctaaattacatccttcggttggtgttatatgtaagcatttccactgcccatatacttaaaagtagaattactagatcatagagtatgcatatgttcaagtttagtagatattgccagttttgcaaaatggttgtaccatatacttaccagcaatatgtataagtcagatgaattttttttaatataacttagatcatgttttaaaatccagcaatggctcttattttactcaaagtaaaagcatacagtaacctatgaggcctaacagagtgtagctcatttccctcttaatcactctaacctcactccttttctcccccttcactcatgctgctctggtgacagtggtgtccttgttaagtcttaaacatgccagtcatgttcccccttagggcctttacactggttgctccctctgtgtagaatgttcttccctcagatatccatatggcccactcccacacttctttcaagtcttggttcaaatgtgaccttctcattgaaacctaaactgatgtctgtattttaaattgcagtattcaatcttccccctcaccatcagcctatcttagtacttaaaatcctttttaccctactctgttttatttgtttcttttgagatggggtctcactctgttgtccaggctggagtgcagtggcaggatcacagctcgctgttatctcagcttcctaggctcaagcaagattcccgcctcagcctcctgaataactgggaccacaggcatgcaccaccacacccaactcagtttttgagattttttatggagatggggtctcactatgttgtcaagtctagtcttgaactcctgggctcaagtgatccacctcagcttcccaaagtgccggcattacaggcgcgaagcagcacacccagcctctcttttttattttatagcatttatcactttcaaatatacttcgtgatttacttgaatatgatttacttatttaccatgttattattttcttcctctagtgcccagaacactatctggcacattgtagataatctatatatgtttgttaagtgaatgaaagcaaaaaaaaaaaaaaaaaaaaccaacaacaacagaaactgaaaagagcccaaaagctaatgacagaataaacaaattatagttatttacataaaaacataaatgaaaatgaggaaactacagctatatgaaactacatagataagtcctagaaatcataatattgtttagggatatatgtgatttttttgtaggaaattatttttaaaagaaaggtaagaataaactcaaaattcaggataatggagacatgagtggcacaaagtgatggattagatggtgaaggagcacatggatgcaacagtgttggtatgatctgtttcttggcttggatggtggatttgaaacagtcactttaatgacttgcactattttcttttgtatgtatcaaatattgcataatcaaaattttatttaaaatgtgaaagtgaatgtaaggtcagaaaatagagtcatgttatagagttaatgttatatagagttatgttagaaagtagagttatatagagttatgttagaaaatagagttactgttaattttgagaagtttgagaaaagagtggtagctggatggtatgatggggcagaaaaaaagtgtcagtgagagatggatgatatgcatggtttatgtgtgaaactttaccatgtttatgggcacagatgcaatggttcaaagagactgaacaaaggaaaaggtaaaaatacctgacaggacggaaatgaccagtgaagccaagtccaagtggaggatcagatcaagagtaaaagaggaaagatacctttgatctagtgaaggaacaatgcttcttctgcaaatagaggaaaggaattagaaaagtgtgtatgtaatattgagttcagttccataacatcaagagttcagtttcatgtcaaataatgtgaagagttcaatttcgagatatggttgaagtcaggttggggagggctcttaaagtgtaacgagaatctctgataatcatcctagaaaacagtgtaagggattgaccagggaaagattcatgaaaggattcctgagcagtgctgacagctgagttaaggctgaagatactaaatttataaacatgccagtctgagtactgcttgatttctacagctcaggtgtaagagaagacggattgaacttggagattttcaggagatggggaagtcaaaggaagacatggatgagaaaggaaatcaggctatgaaggcagtgttggatcaggagaaaagggagatcactatgaagaacaaatgtagaagaaagagaactggagagatgaaagaaagatatgatggccacatgaaagtttgatatttcaaagatgagatagtggagttctaagtaataagttccaggatgtatctttgaacatgggttactaaaaatagaatgaaagacacgagttcaaggaattttaagcctagattttggacattaaagtcatgctgatagacaagagttgggatagagaacaaaattgatcacagcgccaaagttctcaataaatgaggactcagccttaaagcattgagaaggggtagagggttgtatgcacatatgccgtgatctcaaggaagaaggaactttagcatgaaacaggaacaacagtggtgaagggaagcagccttggagtatctgcagactaccaacactgcttcaggagaggataggaagtctctgctcctggggcatgctggggaaagttttctacaggacatccatgcttcatttcaaggcaacacaggaacaagtgttctgtaaaaaggttgaggatataggagaatttatttataatggaaaaaaactttctagtgagcataatggaaaggattgaaaggagatgataagttaaatagtcaagaaatagaaatacaggctgtgtgcaaatgtgagccaaaataagaaggtgggctgcagaggcttgctttttgtttaggggctgaagatcagagacatggtcggatttacaggggggctgggtctaacgtatatgagtacattctgttgagaccaggagactccttgccctttggtctcgtttttcagggcaaccctgccttttcataggaattttgaagttaacaattacctttccccacttgtaagaataggcccttactgtcttatctcctctggggtgtcttacatatatttattgagacctatttctctaggttatcctttgccagttgttttccacctttgtgtgagatggggcctttgaacatagtttacactttttgaaaagtatagccttattattagataatcctgcctttgcctcgctttgtgcccttggcatgttactctgcttcagttttcttacctggaaatgatgctcacttcacttgttaggattaagtgagttaacgcaagtaaaacactccaaatgatgcctagtatgtactctgcactatgtggttatttttgaaaacatggtgatcatacttttacatattataactatttactgagtatcatcaaccaatatacttgatactttaaatttatttaatttcattctcacaacaatgctatgatgttgattaaccttgtcactgaaataagctaagacttcagagaagagcagtaaattgccttgctaataaatactgaagctgttattaaaatatatcttttaataccaaaattcactttctttccactgtacaacttgttacaaaccactgtcattatcattacctgtatatttttgttagctgttaataaatttcctctgaagttacatagcaccataaagtaatgaaagatctccaaaagttcttattctttcctgttgtaactggacatctttggtctcctttctggtctctacttgttcttggatagagaactctgaacctgcacctgaggctgtcttttcagattcgtggatatgagtaagaatgccatctactgagcacctgcactttaatttaaatcttaaatttaaaaaaatcagaaagaaaataaaaccaataatgaaagtggtagtctttattctcttaagaggcaaataacagcctgaaacataaatcccacctttgagacacatgtctatcaaacctatattctatacacaattatttgtgtattgtggatattccttaaggattgagtatggagaattacgttatacaatgacatttcagactgaatcttttaaattaatattatctcaaatgttctaaatgaaaattagcggcaggctgcatgagtaaaaaattagaagatagcacctgtggtgttattgaacacaaagagaatcattgtacatcaaatatatatttctgaaaagtatactttgatgagcttttgaattggttcataaggaagtctgaaagatggtcaaattcagggcagcagcagtagaaatcatttaatcttttttttcccctatatcagaaatgctgcaagcgggaacgtttgcttttttttcccccttgccctttcctgggtcactgcaggtcacgtgatgactgtcacgtgactcggtcaaaggatcttttcctcttacagccttgcaaaaaaaaaaaaagccgttctccaattaaagctgttaacgtgtactacgctgtttccttgttggattttcttgttctctgctgctactgtaaaaacgaaatgagtggtaagatttgctgttttcgaacattctgcttttattttaagacagaaagcattgtattaatctaaagtcatgccgtgtgtttttaaaaatagatgctaaatatcatcgccataaaatattttaaattgttgccatgtaaatacaaaaaggttagactatgtagagttattttgtaattttgtattccacggaatattccattctaggatctttattttactaggtttttcttctagagctaaaatctgaaaattggcatcagattatttggaagccattgtgaacgctggcttatagagaatgtgtagcacagcggcagcacgttgcattttaagaattaaaactcctggacaaatttgtaattttatttaaaaaaaacctcttaaatatgaatgtatattaacaaggaaagataaagaagaatttaagttatactagttgaaatatcttctttaagtcagtgatggcactttttaagaagcaggggtggggagcttctcaaatttcttaagacaattggttagaattgtttactcttctgcaggtttttgaaataggaaatgtatccttaatagctccatgattggggtaaatcatgctcaaatcacatagattataaaggagctgctaagtgtatgcacagttgttgtcaggtattgctactcttgtgccaggcatacatttgtcaataggatctgagtttcttccttgggacaaaatctccctcattgcatacaaatttaagtcagtttgtagttaattttctgttactttctaaattaaaaagtattgttggaactaaggagctaatcaaacatttacatcattaaatatgcaaggctttaaggtttcgctactatagacacaggagtaacaacagacatgagatgctgtaaacgttgtagttctaaacatcgatacttgtatttattatgtttatacaataggggtttgcattcagtgttgaatgttacttcacagcaatattttaggcattaaatatgataccgataaattgtctttttaaaagaaaatctggccgggcatggtggctcacacctgtaatcctagcactttgggagcccgaggcaggtggatcacctgaggttaggagttcaagaccagcctggccaacatggtgaaaccccgtctctactaaaaatacaaaaattagccgggcgtggtggcacatgcatgtaatcccagctactcgggaggctgaagcagaagaatcacttgaacccaggaggaagaggttgcattgagctgagatagcgccactgcactccagcctgggcaacagagtaaaactccgtctcaaaaaaaaaaaaaaaaaatctaaccatgtacaatttctgcctcaggataaaaaaaaaatttttttgctagagtgaaaggattacttcgtaaagaagtaagttaatcagtctttttcctggactacatctagtaatatatttactactggtttattttagcttacatttctcttttcagcatcacacttagatataattaaaaaacaaagtagaatcttgtattaccaaattataaactattttagcggctatcaaagtataaaatggtttgaattgtaactacatatatattcgtatttctggtaaaaggagggccacttgaagcaattgtgtgattttactattttaaatgtaattagcaataacttattattctgatggcaaaagaaaaacctattctgatgacttgatgtaaggattaaatttgacagcatataaaaggacccacagtaaaagtgcaatgctaatggcctttattaacattataaaatatgattttcagtgaattctctgtcaagttctcagctgaatttcacatattgtaagtaatacctaagccacctgtaaggattcaggaagttagtttactgtagttttatataaattagctaatggaagtaaaccagcattagtttaaaacagttctcatttctcttgagtctagaatataggagctaaaaggtgagttttgcatgaagcttttctgcctagaggtataaagcagctcacaagttttattcagtaaattaataggtaatgtttgcttaaacttaagaaaattttattctttctctcatgtttttacggatgtaaagacaacaaaggccttaattttccttagaggctttagagcattgttcttaagcctcaaattatatcagttgccaatactgcatagtattttaatgtttactaaaaatgtggtaaggatatgtccttagaaataaaactacctggttttgaatcccacttctaccacttggggagcttaacctctctgtgcctcagtttccacatctagaaaatggagatgatgatgatgatgatatttacctgatagaatgattatgaggagaaaaaatatgtaaaaggcctggcacatagtaagttagtattagctatatataattaaaataatattctggacaacttcatgtatttggtggtggtcttgttttggatgggaagagtatcttattgaaaagttcttttcacagccagatattatatagtgtaatttagtgttctacacaaacacttcttactttctctcaaccacttcagtcttatccctactttctcttcccctccccacctcttctgtcctttccctcccctccccctttctcctatttctccacatcgttcctcctcccccttacccttctgttttctcctctccctcccttcttgtcttctcttcactctcctttactgcctcttgtcccctttcttatccctcccttttcttctcttacctctcgcctctctccttctctcccctcttgcctttctcctctccttgcttgcttcccccttttttcctccactttccccactttccttacccctgtttagtattttccgtcaccccgtttagtagtttccctcttacaccccctttcttttgtattctcttttctcttccctagctctctcatctccctagccctaatttcatcaccactgtgtggttctgtcctcaccccttgccttccctagaaagggcagaatggctgtaatccggatttgttgtgacctccatgtcctttattctgattttctgaagtatgtataatattaacagagttacttgttttctaccctacatttgagcttttcctcctttatttcttttatagctgagagccattatataatggtagattataattctgcatataaaagagatccttccccctttacattcctcatcagacctttgttcttattcccttagaaataagtaatttctttgaaaaggtttcatttcaggttataaaaaactggtgggcatgaggggacactgcagtgtaaagttacaggaagaaaggaactgaaggggggtaagagacttttttaaaagttacataaagcaactaagattttagttcctagaaagaacaaaacacaccttctccaaatgcttcttttgttcccagaaatgttaaaagagaaggtaaactagagataatagttataaaagttaattggaaaacctaacactataaaagtgaaaggaagtgtagagtgagagaagctgaattttcttttttagaactttttagtgtgagaaacaaaaaaaaatttttttttcctttgggtaagtacacgtgtggcatttctctttgttcttaagcccccatagacatgagtcacacattacacaagtattttaaccctaacaaagcaagttccaaatttctaactattcttcctcttgctgcttttcactcttgcttttttattttgtccctgtaacttttgaaaattttgccttttgtatttttcattgattttatatgcagagtttagtttgatttttctctaggtcagtgtttctaaacttacactattataagagtcacctgggatatttgtaaagtgaatataatgattcaagaccccattgactaagaatctctaggagagcctgttaatatgttttaaaaagccctccaacctccccgccccccaccacccctaccccagcaactttaaaaaacacaaatgtaggtaaagggtaatttgtgcactttacaagataaatttttataacaagtcaatcatctgaatttctttttataaaaatgtagttactgttggcttgagtgtttagatgaagtattcaaaatgtaattcaaattgttttcaactttagcctgataagcaatcatgggttaatacatcatttatgtgacccattcaggtcctgctcaggttccaatgatgtccccaaatggttctgtgcctcctatctatgtgcctcctggatatgccccacaggtatgtttttatgctatttttcttttcatatttgtataatagtgataatgttattctctttgactttgattttgatttaaaaaaaccatttaattactgaggcttaccaagtgttgtgtatctatcataaatctatttcaagtattttagtacatttggaaaggaagaaaaatttttattggcagcactcatcatttgtccttgtctttgggtgttaagtcacaaaagaaaattcattctagagttttgtctccctaaatatatgactaaataaaaataatattttaggttgtaaaggtgcctacactgacatttttaaatttagaaatttgcttagatgtaacccaagacaatgcttccaactttattcatacaatgaatctcagacactgttgataattgcatggcatattgtgttcaatagaaaagagtttagcaaccctgagggatgagggggggggggaaataaaaaaaaaaaatcagtatctccatacacctgtaaccttttatgcataatgactgggaagctctgaccttaagtatagtaatttatgaacacaggcaaactgaattaaactgtaaaatctgcaggtgttcaatatcttccactactgagatttcgtatggtctgcacgctttgcctcaatctattttgggaaataatcattttctctccctagcattgaatttacacttgaagtttttcttcaggccctctgttacttcctccctgattatgccagaatattggtggtgggatattggggtggattttctgcacactctgtgaagcacaccatcatatgaaccacagcaaaagaagagcgtgctgggaaggagagaatggaatgagatttagaatggattcagaaaagctgaatccatatcttatttcaaacctttgctggctgcatggtcttgggcaaatcaacttccttcagtctcagtgccttcattatgagatgagatcacgtactgaaattaccttgtaagcttttcagagtagtctctactaactatctctacttttgtttagcacactgactccttaatatagtctgcattctgtctatattactctactaaaactgctttccgctatgtaccaaatccaaagtcctgctttccagcctggtcctctttgacctctaaaaatttggtaccactgataagatttactacagatttccttgacatcatgctgccctgatttttgttttctacttctttgttgcaccttctcagatcttccttctcttacatgaagactgttctctagcatagttcagttcatgatttattgagtggcaccacgtactgagctctgtattgggagctagtgataaaaagatgattaagacaagttctttcagtgcacttaggttatctgctgttctctcatcttacagtaccttttcgttttattttttgtggcaaactcctatccttttcatttcacttcatcgtgagctctgaaagcagttttccctgagcctttccaggtgcttctccctttgggctttcgtggcatattattaatatatatattcctcttttcataaacttatgaaatgtgtaattctctttcctgagactatgaattcttacagttcctatgttcaacagtgttccacaaatatgtattgagtgtttatatatgtcaggcactcttgagtgcttggaatatgtccatgactgaaagaggcaaagactcatgccgctctgtggtttatattcttctgggaagaggcaaataaaaagtggataaactctataatgtttgctgggcatggtggctcacgcctgtaatcccagctctttgggaggccaaggcgggtggattacctgaggtcaggagttcgagaccagcctggtgaaaccctgtctctacaaaaaatacaaaaattagctggtcatggtagcaggtgcctgcaatcccagctactagggaggctaaagcaggagaatcgcttgaacctgggaggcggaggttgcagtgagccgagatcgcaccattgcactccagcctgggagacagagtgagactccgtctcaaaaaaaaaaaaaaatcctataatgtgttagagctggttatattttacaagagtggtcggaagaggcctcattgggcaggtaagatttgagccaagtcttgaaggacaggtgggggttagctatgcatctatctgagaaaagaggattctggacagaaatggccagtgcaagtggctaagatgacagcatgcctgggaacagcaaggaggtcagtatgattggactgattcatcaagggagaatagaagggaatgaggtaagaagtaagaagtctagatcatataagactcttacttatcttcatatcctcaatgccaagtatatagcctgtcatatagtaggagctcagtaaatatttgtaaattagataatcatccgagttgaggttctgtaatctttagaccaaaagccacagagataatcttcctatagcatttctttggtcataaagagcctgtagccggcttgtacactcaatgaagtctagatttcttgacatttaaggctttacacggttctgtcctggtttgcctttgcaccattttcttgatactttcaattatgtccatttttgtagccgaacatttctcacatgcttacttggtgtttccttaatgctgttatctaaggaatgttattcatttctccatttctgccttttaaaattctacccatccttgagggcctacctagatcatgttattgaaccacttcttggttataatacatatcacctaatataattatgtactgttagcccttcatatccttaggttccaaatctatggattcaaccaaccacagattgaaaatatttgaaaaaaaaaattgcatctatactgaacacgtacagactttcttgtcacatttcttaatacaatataactatttacacagcatttacattatattaggtatgataaataatctagagatgatttaaagtacacccgagggtgttgtaggttataagcaagtactacaccgttttatatcagaggcttgagcattagaaaattttggtatccacagaaagtcctggaaccaatcccccatgcataccaagggacaactgcatatgtatttttactcctacaggattttaggttccttaagataggaactgccttttaattatttttgtgttcttgtggtaactcaaatgtagtaagtgtcccataaatagttgtcacataaattaatgaattttaacaataatcttcctggaaggattatgtgaggttagtgggctactattattaatcttaatttaagatgaagattatctctagaaaatgtgtcgttttcattacacagggtaatccaaagacaaaaatctagtcttatcgttttttagttaatttaagtttccagtatgtaagacttgattcttccacagagggcaagcccacagagggcgagctgaagcagggtggggcatcgcctcacccaggaagcaaaaggggtcggggagctccctcccctagccaagggaagccatgagggactgtgccatgaggaacagtgcattccggcccagataccacacttttcccacagtcttcgcaacccgcagaccaggagattcccttcggtgcctataccaccagggccctgggattcaagcacaaaactgggcaggcatttgggcagacactgagctagctgcaagagctttttttcatattccagtggctcctggaacgccagcaagacagaaccgttcactcccctggaaagggggctgaagtcagggagccaagtggtctagctcagcggatcctacctccacagagctcagcaagctaagatccactggcttgaaattctcgctgccagcacagcagtctgaagtccacctgggacactcaagcttgatgggggaggggcgtctgccattactgaggcttgagtaggtagttttccctgagcagtgtaaacaaagccaccaggaagctggaactgggcagagcccaccgcagctcatcaaagccactgtagccagactacctctctagattcctcctctctgggcagggcatctctgaaagaaaggctccagccccagtcaggggcttatagataaaacgcccgtcttcctgagacagagcacctgggggaaggggcaagtgtgggcacagcttcagcagacgtaaacgttcctgcctaccggctctaaagcaagcagtggatctcccagcagagctcccaagctctgctaagggacacattgcctcctcaagtggttccctaacccccgtgcctcctgactgggagacaccttccagcagggtcgacagacacctcatacaggagagctccagctggcatctggtgggtgcccttctgggacagagcttccagaggaaagaacaggcagcagtctttgctgttctgcagcctctgttggcgatacccaggcaaacagggtctgagtggacctccagcaaactccagcagacctgccgcagaggggcctgactactagaaggaaagtaaaagaaaggaatagcaacaacatcaagaaacacgatgtccacacagaaaccccatccgaaggtcaccaagacaaaaggccaaaggtagataaatccatgaagatgaggaaaaaccagcacaaaaaggctgaaaattccaaaagcctcctgcaaaggatcacagctccttgccagcaagtgaacaaatctggacggagaatgagtttgacgaattgacagaagtaggcttcagaaggtgggtaataacaaactcctctgagctaaaggagcatgttctaacccaatgcaaggaagctaagaaccttgaaaaaaggttacaggaattgctaacttgaatgaccagtttagagaagaacataaatgacctgatagagctgaaaaacacagcacaagaacttcgcgaagcatacacaagtatcaacagccaaatcaatcaagcagaagaaaggatgtcagagattgaagatcaacttaatgaaataaagtgtgaagacaagattagagagacaagaatgaaaatgaacgaacaaagcctccaagaaatatgggactatgtgaaaagtccaaacctatgtttgattggtatacctgaaagtgatggggaatatggatccaagttggaaaacactcttcaggatattatccaggagaacttccccaacctagcaagacaggccaacattcaaattcaggaaatacagagaaaaccactaagatactccttgagaagagcaaacccaagacacgtaattgtcagattcaccaaggtagacatgaaggaaaaaatgttaagggcagccagagagaaaggtcaggttacccacaaagggaagcccgtcagactaatagcaaatctctcttcagaaactctccaagccagaagagagtgggggccaatattcaacattcttaaaggaaagaattttcaacccagaatttcatatccaaccaaactaagcttcataagcgaaggagaaataaaatcctttacagacaagcaaatgctgagagatttcatcaccaccaggcctgccttacaagagctcctgaaggaagccctaaatatggaaaggaaaaaccagtaccagccactgcaaaaacatgccaaattgtaaagaccatcgactctatgaagagactgcatcaactaatgggcaaaataaccagctagcatcataatgacaggatcgaattcacacataacagtattaatcttaaatgtaaatgggctaaatgccccaattaaaagacacagacaggcaaattggataaagagttgagacccattggtgtgctgtattcaggagacccatctcacatgcagagacatacataggctcaaaataaagggatggaggaagatttaccaagcaaatggaaagcaaaaaaaaaaaaagcaggagttgcaatcctagtctctgataaaacagactttaaaccaacaaagatcaaaaaagacaagaagggtattacataatggtaaagggatcagtgcaaccagaagagctaactatcctaaatatatatgaacccaatacaggagcacccagatttataaagcaagttcttagagacctacaaacagacttagactcccacacaataataatgggtaataataattaacaccccactgtcaatattagatcaatgagacagaaaattaacaaggatgttcaggacttgaacttagctctgcaccaagctgacctaatagacatctacagaactctccaccccaaatccacacaatatacattcttctcagcaccacatcacgcttattctaaaactcaccacataattggaagtaaaacacttctcagcaaatgtaaaagaacagaaattataacaaacaatctctcaggccacagtgcaatcaaattagaactcaggattaagaaactcactcaaaaccacacaactacatggaaactgaacaacctgctcctgaatgagtactgggtaaataatgaaatgaaggcagaaataaagatgttctttgaaaccaatgagaacaaagacacaacataccggaatctttgggacacatttaaagcagtatgtagagggaaatttatagcactaaatgcccacatgagaaagcgggaaaaatctaaaatcaacaccctaacatcacaattaaaagaaccagagaagcaagagcaaacaaattcagaagctagtagaagacaagaaataactaagatcagagcagagctgaaggagatagagacaaaaataaacccttcaaaaaaatcaatcagttcaggagctggttttttgaaaagatgaacaaaatagatagaccactagctggactgttaaagaagaaaagagaggagaaccaaatagacacaataaaaaatgataaaggggatatcaccactgatcccacagaaatacaaactaccatcagggaatactataaacacctctatgcaaataaactagaaaatctagaagaaatgggtaaactcctggacgcatacacccccccaaagactaaacaaggaagaagtggaatccctgaatagaccaataacaagttctaaaattgaggcagtaattgatagcctaacaaccaaaaaaagcccaggaccagatggattcacagcctaattctaccagaggtacaaagaggagctgttactattccttctgaaagtattacaaacaacagaaaaagacggactcctccctaactcattttatgaggccagcatcatcctgataccaaaaccttgcagaagtacaacaaaaaaagaaaatttcaggccagtatccctgatgaagatcaatgtgaaaatcctcaataaaataactggcaaactgaattcagcagcacatccaaaagcttatccaccataatcaagtctgcttcatccctgggatgcaaggctggttcaacatacgtaaatcaataaacgtaatctatcacataaacagcaccaatgacaaaaatgacatgattatctcaatagacacagaaaaggccttcaataaaattgaaggccttcatgctaaaaactttcaataaactaggtattgatggaacatatctcaaaataataagagctgtttataacaaacccacagccaatatcatactgaatgggcaaaagctggaagcattacctttgaaaaccagcagaagacaaggatgccctctctcaccattcctactcaacatagtattgggagttctggccaggcagtcaggtaagagaaagaaataaagagttttcaaataggaagagaggaagtcaaattgtctctctttgcagatgacatgattgtatatttagaaaaccccatcgtctcagcccaaaatctccttaagcagataaacaacttcagcaaagtctcaggatacaaaatcaatgtgcaaaaatcacaagcattcctatacaccaataataggcaaacagagagccaaatcatgagtgaactcccgttcaaaattgctacaaagagaacaaaatacctaggaatccaacttacaagggatgtgaaagacctcttcaaggagaactacaaaccgctgctcaaggaaataagagaggacacaaacaaatggaaaaacattccatgctcgtggataggaagaatcagtattgtgaaaatggccatactgcccaaagtaatttatagattcaatgctatccccatcaagctaccattgattttcttcacagaattagaaaaactactttaaatttcatatggaaccaaaaaagagcccatatagccaaaacaatcctaaagaaaaagaacagggctggagacatcatgctgcctgacttcaaactatactacaaatctacagtaaccaaaacagcaaggtactggtaccaaaacagatatatagaccagtggaacagaacagaggcctcagaaataataccacacatctacaaccatctcatctttgacaaaccgggcaaaaacaaccaatggggaaaggattccctatttaataaattgtgttgggaatactggctagccacatgcagaaaactgaaactggaccctttccttacactttatacaaaaattaactcaagatggattaaagacttaaatataaaacctaaaaccgtaaaaaccctagaggaaaacctaggcaataccattcaggacataggcatgggcaaagacttcatgaccaaacaccaaaagctatggcaacaaaagccaaaattgacaaacgagatctaattaaactaaagagcttcttctgtacagcaaaagaaactataatcaaagtaaacaggcagcctgtagaaagggagaaaattttttcaatctatccatctgacaaagggctaatatccagaatatacaaagaacttaaacaaatttacaaaaaaaaaaaccaaccccatcaaaaagtgggcgaaggatctgaacagacacttctcaaaagaagacatttatgtggccaacaaacatatgaaaaaaagcttatcattggtcattagagaaatgcaaatcaaaaccacaatgagctaccatctcacgccagttagaatggcggtcattaaaaagtcagggaaccacagatgctggagagatgtggagaaataggaacgcttttacactgttggtggtagtgtaaattagttcaaccattgtggaagacagtgtggcaattcctcaaggatctagaaccacaaataccatttgacccagcaatcccattactgggtatatagccaaaggattataaatcattgtactaggaccatgcacatgtatgtttattgcagcactattcacagtagcaaagacttggaaccaacccaaatgcccatcagtgatagactggataaagaaaatgtggtgcatatacaccatggaatagtgtgcagccataaaaaaggatgaattcatgtcctttgcagggacatggatgaagctggaaaccatcattctcagcagattaacacaggaacagaaaaccaaacaccacatgttctcacttataaatgggagttgaacaatgagaacacatagacacagggaggggaacatcacacactggggcctgtgaagggatggggagctaggggagggatagcattaggagaaatacctaatatagatgatgggttgatgggtgcagcaaaccaccatggcacgtgtatacctatgtaacaaacctacatgtttggcacatgtatcccagaactttaattaaaaaaaaaaaagtagagaaaaaaagcttcagaagaagcaaactatttgaaaagatgatacatagtccacataccaagattatgtactttacacataaataacctccatagccatttctggggcctgcttggtccttattttaggcagaaccttaatgagctttattgttgcagtttaataaataaggatacttttaagaaattggtgtactgcacagaggcagaaatatgtgccagtggaattaagttatcaaatgaggaaatgaacaaaacatagaactataaaacttaaatacaaagcaagtgatgccaggagtagaaggaacttaattcactggcaaatagtactaacttagagtccctaagagcattgtattgcaggacaggataacacttccgctatttcagtgataaagttaataacttatcaagagaagtttatgaactacctgaatgggactcctgaaaggcaatatcagaagttctgcctttctggtaatggctcccttaactgtttttttatagaatgtgggctgttatggtaatgagagggtgcctaacaaggaaggaattgtagatcgcatagcgtggggaaagaaactatatcgactttgggaaaagtttcaggttactcctttgagctgtgcttgctgtttcattttgcttttatgatggcacgcaggagtgaggtcagtgtgtttttcagatattctgcaaatcaatctgatctcagacttcttgctgctctcctggggacaacagccaaaagggatgggcaggggagtgtgagaaactataagatggggagacctaagagatttatatgagaatgaagagatatagtaagaactggagagaaaggagattgtgatcacatactgttgtatatgtttgtagacacataaatgtttgttaaatgaatggcctatgttattgtttaagagcttaaagttgttttgagcttaaagtgaagctgtattattaagagcttaaagttggaatagttctgggttcagagtgagaccacagaagtaggttgcaaaaagtagagaggaagcaaaggttgtaggaattgagaaagtcacagaaccctaatagcttcatggtgtaaagagagggagaaagaaatgtagcattctgttagtgctaaaagaacacatatatttctgatcatatcattcatttaacaaataactattagagcatcaacccatgtgctaggtactattccaggtcctgggggaaaaaaacaataaataaaacatttattgtgggctttatattctggtaaggaagatacacaatataaaatgtcagatacagtttcctttctctgcagcccttctcaattgtgtctctgttcaataaaggaagaaaaaaaaacatgtctttgcctacttagaaattaggtggcatctgtggttaagtggtcagactatgctaatgcctcatttaattatattttattgccttatctgtattttaatttttatgaacactgacaaatttgaattatattttatcttttttttccttttcacaacgtacttattttattttacatcacaaccagtgtaccctgttggtgtgaaatctgacctctacatgatggccatttcttagcacctaagcctctggagacttagcaaatagttttgaagtctgttgccttcctctgaagttactggctgcttgaggtagtggagttcaccgtgctcttggttcttgtctggcttttttttttcccctcttctgtctacatcttaggtttgggggttttttttgtttgtttttttaattgtggtaaaacacacataacataaaattaccatcttaaccttttttaagtatacagtttaatggcattaggtacatttacagcattgcactaccagctccaccctccatccacagaactcttcatcttgctgaaaactgaagctctgaacctgttaaataatagctctccattttcctctcccctaagcttatctttgtattttaaatgttcttactcatcagaaaagtggttttaatttcataaataatttagccatttatttttaatcaaataaatatcttgtcgtaaacaacaacaaaaaagacactagaagacctatggcttctatgcccacaaagtagataagaacatggaatctgaagccaagttgcccaagtgcaaatactagctccctcactttctacctatatgaccctgggcaagttatttaacatctctatgtctcagtttctccatctgaaaaattgaaataataatagtatgtagcattgttccaaggatcaaatagttcatatatgttccttgagaaacttaacatttaaattatagagtaagacatatgcatctggaaaattaacatttcagtgttacaaatatccagcaagtgatacagaataaatgcagtagaaattataggagagagagatcactgagattgtggtacctagggaagagttcatggaggaacagtcaaacggtatcttccacagactcctagccccacacttccaccagtgtttgcacatctgcagttatgtgctctgcttctcatccagcccacaaactctgtttcctcatctgtaacacaaactttcctgctcctgtccagacccggttcccccactgggatactggaacccatcccattttgcctgtgtaaggacacattactctagcatttttcttttctctcttctgtgttatcaatttcttgttctctgctagattattttcattagtatcttgagccttttgtaatttcactcctgaaaacaacaaaacatcaaagtttcttgacttcactacttgtatgagccaccaccctatttctgtattcccctttgcagcagaacattttaaaattgtgcagttagctctaattcttctccttactttctcacttaaacccactgcagttgggctttgaccctatgactataccaaaactgccctcttcaaggtcacagtaatgtctacattgctaaatccagtggtcagattcttagtcttcctcttgtttgacctatcagcagcatttgacacagttaatccttcctccttgacatgcttcaccaaacttcagactctatacactgtcttagttttccttctgcctcgcttggtcatcccttcccaatctttccagaattgcagactagtatatcttaacagtctattcaacatttccactaagttgtcttataaactcttcaaactcacaagtgcaaaacttgaaactccaaatctcttcccctgaaaaaaacttgttctactccacagccttcctcatcacattgatggaagactattgttccctaacttctttttctcacttcccacatggaatcatcagctaatcttgtcttgtttctctactttttttttttctttttgagatggagtcttgctctgttgcccaggctggagtgcagcagcacagtctcggctcactgcaacctctgcctcccgggttcaaacgattctcttgcctcagcctcctgagcagctgggactacaggtgcgtgccaccatgcccagctaatttttgtatttttagtagagatgtaatttcaccatattggccaggctggtctcgaacgcctgacctcatgatccacccacctcggcctcccaaagtgctgggattacaggcgtgagccactgcacctggcttctacttttaaatatatgcagaatgtgggtcacttctcaccatctccactgctgcttccctggtcttagctgtgatcatctcttgcctagattactacagtagctttctgaatggtttccctgcttttgtctttgcctccctacgatctcttctcaactcagcagccagaatagtcctgtcaaatataaggttacatcaggaattctcaaccatagtaatgtaaacatttgaggtggggtgatgtttttgttgccctctgtgttgtaggttatttagcagtattccgggcctctctactttctaggtgttaatagtgcacctcccccactgccccgagttgtgacaactataaatgtctccagaccctaccacatatcctctaggagtcagaaacactagattttatcactcttctgcccaaaactttgtgatgatttcccattccactgacagtaaatgatgaactccaactccttaatagtagcctgtgtcgtggtgcctgacctgaccaccctatcaccgcttcatttctttgacttcatctgcttctgcctttgctcctttatactcatgcagtcacaccagcttcctttcatcccttgggtataatcagccccacttctaccttaggggctttattctaactgttccctcttcctagaacaaatcttccagatttctacatagttaattcctccacttccttcaagtttctgcttaagcttttctttgccagtaaggcctactctgatccctgtgtttattctgtaacctgctcctttctcacaacacttctaatagcccttacctgctatgccttttccatagtatttatcaccttgcaacatgctaagtaacttacttgttgtgtttgtctgcccctgttagtgtgggttccccacaaatatttaatatatcattctgaggtttttccctctttgaattatcagtttgttttgctgaaaaatagtgttttaaatgagtggagaaggtaaagttagagctagaattggaaggatagacaagattattatagattaaagggaagcaaagtgaagaagaataattgcataaataaaagtacagggtatagaaatgtatagtcactgtgaaaacaggttttttattataccagcctgactgcagttaatggttcaggatttgttgcaaaagaacgatacaacttagaaggtagtttggaaccaggttgaatgaatatgaagtacaagcctcttggaaatggctccgttttttaagatttgtgaattggagagtgataaaggtgaaatgagtattgtgacagatactgtgatttggctcacttaaaatccatttcaaacttcttccagtgttcgttcctgtagggtagaagctaaaaagctatcagcagttcccagattcccttcaggtagggttctagatattgtttagttcccatcaatcatatatgtttgcttgagacttaaattcagaactgagttaaatagggagaaaggggtctgaggcatccattttgctgaaaacaaggcattatggttctagacccagcatattaaaaacagttaattcatttggtcatctagtcccctgttagaagagtcatgtcacactccagtaggtaaggatagtttaataatctaattaatgtttgtaatttaggcttatctatacccagataagtgtgttttctagtatacctatacctaccaagcacatatatttataaaataatttgctatccttaagcataataaacctttgccttcctgaaaatcaggatttgcctttaaattagcacttaacattatgatcattttctgtttcctgaggaaggtattagccatttgttataccttaataattaccatataagtctaaaagaataagggccttattttagtgagggatttctaattttaagataaagtcctttaattttttagggtttcctgtgtgtctttgcagctctagtaaggttcaaagaggagtaagtcttgtcatttaaaaaaatttatccccacggtgtaattcctgttttttgttttttggttttttttttttagtttgtaatttctaagcctcaaagccacagatatttttcctagctaggagttaatatagtaatattcagtatttgtgtcccttgaaatgatcagctgttaaaattgtcctggtcatggtcataagaattttacatccaaattctaacatgtcattgattatctgattgagtctggatccagttgttttgttttctatttggtctttccacaacttgttttcccctactcctagtcataatatagaaaaggaaattgattcctgaacctcttgtgtctaaaccaaaattactccatcaggaaatgcacataacacataggataaatatctagtatcataacttattaggttactctttagcttgtctaatcagtgttttaagatttatattgaattgtataacaaaaactaattcattttgtttagtgctaatttacatgtaccaatatatttaataagttgttttcatgttgattctccaaatttttaaaatttctaatggtgtaaaaattcttactcttacatttttattttattttatttttgagacagagtcttgctctgttgcccaggctagagtgcaatggtgctatctcggctcactgcaacctccacctcccaggttcaagcaattctgcctcagcctcccaagtagctgggattacaggcatgggccaccatgcccagctaatttttgtatttttagtagagacagggtttcgccatgttgtccaggctgttctcgaactcctgaccctaggtaatccacctgcctcagcctcccaaagtgctgggactagaggcatgagctaccgtgcctaccctactcttaacatttttaaaagaattgtttatattctatggaagaaattttaatctgatgttcattttgtaggttattgaagacaatggtgttcgaagagttgtcgtggtccctcaggcaccagagtttcaccctggtagtcacacagttctccaccgttctccacatcctcctctacctggtttcattcctgtcccaactatgatgccgcctccaccacgtcatatgtactcacccgtgactggagctggagacatgacaacacagtatatgccacagtatcagtcttcacaagtctatggagatgtaggtaagacatctaaaagtattccactgttattgagttggatattcttcgcttggatataatagatgccattatcatatcacattaaaaaaacagcaaatggtaatgatgtaacaggcatttttcttttactcaagtactatattaggtgcttcatcctcatgatcacccttcaaggcaggtaagtaaacagaaaaatcaaagaagggaagtaacttatatcatgcagcactacttagtggtgccacattcaaacaagaggtcttttcctctggcctgcaatctaggcactgagaaaattttcagccaggaataaccatgtcattgttaaatcctattggctgtgatgccactacacaaagctgctaagctctgtgagggattgaaaaaacaggataagccataacctctgccctcagggagttaataaatttggggaaagttaataaataaagttaataaatatataggctaccaaacataaacacaaaataataccttattatgtcccatagctttaaacactgccttaaacagtgccagacttattcctgactgccttctcgataacttcacatggatgtctcttgcatttcagaatatttctaaacagaaatgtcaaatgtggacccccacgacttgctttttttccgtcccttcatctcagtaggtggtccactagtcacttagtttgctcaaatgaaagccagatggtcaaatttgatttctccttttccaacccttacatcaattagtatcagttttattttcagaattttctgaaattttttttactacttccccactgccactcaaatccatccaccatcagctcttgccaggacaactgcaacaatggccttccagttggttttgtttccattcttgccctcaataatcaattctcagccacagtaattattttcaaatattaatcagactgttctgtttaaactatttcagtgatttcccattgcaattagaataaaatcctaaacccttcccctagactagggtttctcaaacatgccactattgatgttttaggacggataagtcttcattgtagaggacaaaactctgcactgtaggatgtttaaaggcatccctggcctctactcactaactgccattgtgtagcacagttgtagcacacaactctgacacaacattttaaatattctgacatctaaaaatatctccagacatttccaaatgatccctaggaaccaaaattagttctggttgcaaactgctcttgcaatgttctgccctgtggcccctgacttccttgtcccattgcttccccttagtccccttatttcttcagtttttcaaaaccaccaagttctttcttgcctcggtccctgtgtacatggtgttctctctgccttttctgtaaatttcctttaacctttggatttcagttttcagagagaccttcctgatcttaccttgttagtctctagcactgaactttgtatctttcacagaacttaacacaatttcttttttgtcattgtgtatttgtatggctgtctcccttatttgactatcaactccctaagaactgaatctattttaatcactattgtttccctgcacttagcattgcctgtcacttatgctcagtacatttgcagaagaaataacttcaaatacaaaattgaaattacacaacacagcctgtaaatagtggatatattgtacacatcatatgtatttgtcaaacttatttctattgcccaagtaatgcaaattggttcagtagctctgggtagtgcttgagattctgcatttctaacaagcccctaggagatgttcatgctgtgctccaaggaacatacttttgagtaccaaaagtttatactgcagattagtctcatcctatttttgtttactgctaattatgacttagttttaaaaatattaattttttcttataatctgagaaaactataagaaaaagctagtattacaattattactattttgcattgttaaaaccccttgttattctgtagggatatgcattagaatacatggatgtgatctacattgatatgaaggaaagtgaagggcacaaatccacaaattagctacccagtggtaaaagggaggagtcatgttgtacttgaggttataagccagagattctaccactaaatgctaattattgacagtactggttttctaaccaatggctatacctccgtgatgtcctttccatgcacaatccatatggattctcaaagtggaatctgatccagcatttcactgttagcagtaccattagtgagcctgaaccttgctaggcactatgctcacacatgtattatctcacttaattttcaataaaattctgcaaaattcaaatgaggaaaccgaggctcagaaatgttaagtaatttctgcaaggccacactgctagttaattgctcagaattttaaccctctcagatctattcaatgattaagttccttctctttctactataatatattcttttttctcttccatggtagctttattattttgaataatagataaagcattttaaagtatgtactaattgatctaattgattgcagttgctatttttcttaactttttgtcgagatataatttaggtaacagttcatcattttacacttcagtggtttttaatatatttactttattgtgcaacatatgcaactcaatgttttctatattcagtatgtactgtattaagtaccactgtctaattccagaacatttctatcatcccaaaaaagaaactgtgcatattaacagtcagtcccaactctctgttccttcacatcccatgatctactttctgtctgtatgggtttgcctattctagacttcatataaatatacatataagtatttcatataaaaatttcattaaaatgttcatacagtatgtagacttttgtgtctagttttttttcacttaatgtcatgttttcaaagttcatgttctcacatataatagtacttcgttcctttttatggctgcaataatattgcattctgttgattacattttatcactcattagctgatggacctttgggttgttttcactttttgtctatgaacaatactgctgtgaccatttgtgtaaaagtttttgtgttgacatattttcatttcttccgggtatgtgcctcagagtggaattgctgggtcatatgttaattctatattacttttccacagtgactacaccattttatattcctaccagcaatgtatgagggttccaatttctttgccaaaacttgatatcgtctgtcttttgattgtaggcatcctgaataaatttctctctcattatggttttgatttgcttttccctaatgctactaatgttgatcatcttttcatgtgcttattggccatttgtatattttcttttcctttttttttttttttttttttttgagatggagtttcactctttttttttttttttttttttttttgagacagagtctcgctctgtcgcccaggctggagtgcagtggcatgatctcggctcactgcaacctctgccctctgcctcccaggttcaaatgattctcctgcctcagcctcgcgaatagctgggattacaggtgcgcgccaccacgcccggctaattttttgtatttttagtagagatgggatttcaccatcttggccaggccggtcttgaactcctgaccttgtgatccacctgcctcaccctcccaaagtgctgggattacaggcgtgagccactgcgcccagccccattcatatattttctttggagaaatgtctatttgaattcttcacccattttttaaatgggtgggatatttgtctttttattgttgaaaggtaagagtatatatattctggatacaagttccttatcagatatatgatttcctcccttgttgttttttcactttccttgtggtatcctttagtgcagaaaagtttttaattctgatgaaatctaattttttctttgattgcttgtgtttttggtgtctcgtctaagaaactattgccaaatccaaggtcatagagacgtgttttcttctaagagttctatagtttaatctcttacatttgggtcattgattcatttgaattaatttttgtatatggtgtgaggtagaggtccacgttcattctaatgttattgtacatatccttataatactcatttcaaaaatactgtactaattttcttaaggcactgctaaattaaaactttttactgaggcttttaaaaaatatttttctcatcacaaattttaaatttaaaaaactctggggacaattgaattaatatttattgagcataatgacttaattatgttcctatgtgacttttattagaatgagtggattcttctaaatcacaaccttgagtttatagtatctgaagatacattatatgtagattgttattgttaaacagtctaaatcatttcttttggctaactttttttcagtgatgattgcttttttgagttataagggaatttaggcaggcagtggttttctttttacctattttatgtgtttaaggttcaaaaagatgtgaaaagtaatagttactaaagagtaaaagaaaaagaactgtggactgctcagctccagtctcattcctcacctacaataatcataagttaccaccaagctgtttctatggagattaataattagttgagaacagaaggaaataaatctctctgtaaatttacttgagagagagatatatataattagaataaatcacaaagcttggttctgatagtttatggagacacaaaggttgctttgttatgcaaaattcttttaaatattttataaaagttttatatgatagatttattttctgttcttttttcatggcataaacttatttggagaaagtgatcttcttaacattttgtttttattgcctcctagatgctcactctacacatggaaggtccaactttagagatgaacgatctagtaaaacatatgaacgtttgcagaaaaaattgaaggatcgccaaggaacacagaaagataaaatgagcagtccaccatcatcaccccagaaatgcccttctcccattaatgaacataatggacttataaaaggacaaattgctggtggtataaacacaggatcagcaaaaatcaagtctgggaaggggaaaggtggtacacaagttgatacagaaattgaaggtaactgtttgaagtactgaactgttctcattgatgctattctcgtgatttaacctactaaaagtatattctaacctttcagtcattttgtcatggtccaaatagactgttacaggctgctgctttcgacagtttggaaagcctcaattagtaatttcatctatatcgtaaattttactgactgaaatttctatttgataggaaaactcagagaacattaatccagattcctttcttctgattctgggcgtttgataaggctatgctgctggtttttaatcaaaactttttttttttgagacagggtcttgctttgtcacccaggctggagtggcacgatcatagataactgcagctggaaactacaggcatacaccaccacacccagctaattttttaatttttagtagagacagggtctcgctgttttgcccatgctggtctcgatctcctgggctcaagcagtcctcccatcttggcctctcaaagtgctgcaattataggcctgagccactgtccccaacctatcaaaactttttatttctcccaccttctttttgagtaaaaccttgatagcaaatagttatatcatttactaatctctctatatactctgtaattaggatagagtatttttcatttctttcttcaaaagttcttttctcctaaactctccttgttactcttggatccttcccctaacctctgacttctactctatgaactttgttttattggtttttgtttgtttgtttgtttttgagaccaagtctcgctctgtcacccaggctggaatgcagtggcgcaatgtcagctcactgcaacctccgcctcctgtgttgaagcgattctcgtgcctcagcctcctgagtagctgggactaaaggcgcatgccaccacgcccaactactttttgtatttttagtagagacagggtttcaccatcttggccaggctggtctccaactcctaggctcaagcagtccacccaccttgaccttccagtgtgctaagattacaggcatgagcctactatatggactttgagcactattatttgtatatacttgaatcaatctctataaggtaaaatatagctgggttaacagcctgtctttcatatgcctacagttgtggagttagtacccagtacttttgattgtaatgttaagcttgtaactactgcttactttgattaatgtagtttctatatgtatgttcttttaggtttccttaatactgactattatctgtttgacgtagatatgcgtatgtagaaatacatagatatgcatggtagaccatgtcaggttctaaaggtttcatcagaaatgactatgaaccataccaacatgtcatttcacaagcaccaataaccacaactctatcagtccttgaatatgcttatctaaattgatatttactatcaaatagtgtaggtaattaatatatgactaggaactaaaatgcttccaactttgagggaaatatcaaaatgtaagccatgtgaactcttcctaccttccttttccttaaaatttccatgcctcactaacaaatttcaaataatgtcttaactgttcatgacttatatattaacaacatttacataaatgttctcccatttatttgagacctgatcatcgttttcagcactgatgtttcagaagaaattaagttaaagttttttgcctatcagtggtggctataagttacagtcaagccaattatatttctaatttgggaaaccataactaaggcatgtcatgaaaaaatagttaactttattaagaggtatgagattgacaaatgagaactttccagagagaatattcttacaaccatgaataaaaatatacttgatataagaaaaatttggttcagatagatatagctatgtctaaatatatatagatatatctgtatatagtggtgttataattagtagtcacagttaagatagaaataaaaactaaagtagataaatgctgaagggccacaaactgctgagtatgaacaaaggaataaaaactagaaaataaaagtctcaaataccaacctagtttcagaatacatatttagggagaagaagggattgtatctaagttcttttttttaaatattcaaatgttttatttttttaagaaaaagatgaagaaactaaagcatttgaagcacttctttccaacattgtcaaaccagtggtaagtatcttatgtattttattgatgtttatatttaatatattagcataagatgttcatccatcaaaatgtagtttttttcttttaactttttatgaaaataggatcatactgtattctgtgacaagctttttcactcactatggtatgctttagctatctttctatgtcattacctgattctttgaagagctacatagttttgtcattcattcatcaaatatttattgatcccttactatatgccaataaataaaaaacaaatgcacaaacagaattctgtgtgatagtaaagattgctattatagaaataggaatgatatgatgagattaataggagaggttgttaggttaaatagagcaatcagggaagctttctctgacaagtgagaaaaagtgcaaaagtggaaggaatgggagagggagaacaggtgtaagtaagcatggggagttggacagagggaaagaaccattatcactggagtatagtgaaggggagaaagatgtggtggaagaagtaggccataggactttttcagccagaataaggcaatttaagattgataagaatattttttggttcataaaacaaactactctttcccaactctcagaaacatccatggtaaaatgttttatactaagttgccccaaaaatactttgtttttctgagaaaacagattagaaaagttattattcttagtaccatctccataaaggctttttaagcttatcttgccatgttttaggatgtttgagtaagccagttcctcatctaatagactaatatggtcctactttttctgacaactcccaaataatagatttggttgctctagctttctttattctaatctgttttctcttgagaatagagcatatatgtgtaaataaatgtaaatttacacaattatttcatagtaatggttaacacaaattgattagcatcagtctctgttcagagtgcttggaatgcacatgtgcattatttaatacctgtgacaaccatatatgtactattttccctgctttacaaatgaggaaactgaagcaacagtgagtttcaattagtagtagtagagctatgactgaaatttaggcagtatccttccaagaccccaagtgtatatcactaggtttactagaaaaagaatttagtaggcttaataagattgatgtttgagtgatttaatagctaatgctagtagcatttacttgttgtagtatatattaaaagtataattttcaggccaggtgcagtggctcacactttcccagtcctttggaaaaccaagacaagaagatcacttgaggccaggagtttgagaccagcctgagtaatatattgagacctcgtctctacaaaaaacaaatacagatactacagaccaagggggcacacacctgtagtcccagatacttgggatgctgaggtgggaggatcccttgagcctaggagttcaatgctgcagtgaactaagattgtgccttttcactccagcctgggtgacagagcaagaacctgtctcataaataaataaatatatatataatttacagacaggaaaagtaaatcttaaagccaattcaaagactttcttactcaacattaggaagaacatgtagtttaataagatagtgagccctgtatcataaagtaatgctgatggttttatttgctttgttttagtttatagtttgaatgccgattcctctttgattaaattaattgtgagctacaaagtgcaggtcagggtttttgcttgcttgtttttgtgtgtgtggttgtttttgcatgctctagttcatttagagcactaaattaaatgtgttcattcactttttcattccataaatattttaccgcttacaaagtgacagatgttgtgctaaagctggagatagaatggaaagcaaaggatagacacgggctctgccacaaggcttagttcagtaaactaagcatcacacaatgaatgttaaattgtaacggtgaagtgccaggacaaaaagatagagagcagtcagagtgtgtaataggaggactaaaccttgacaaggaatcagggaagttttcctaaggaaggattattgtactgacatttgaaggaaaagtagtggttgggcattgaggacaggggtggaaagtgtgggaacagtattgcaaactgagcagcatttgaaaagcactggacatggcacatttgaggaacaacaaaaaaaaaggaaagcagagaaaagctcactcatgtgaccagagtgcagtgtataggggagaatgtggtacatgcacaagtctcatagtctcaactgtgtacttaggagttgagtgacccatgacaagtcacttgacctttgtgaatgtttcttctttcagaaaatggagaataatggtattgtataccctcacatgcatgaaataattaactatattgaaagtgttgtcttttcatttgttcttctttgaaattgttctcagtctcatttctgtgaaaatctactgacatttatttcagtggatttcatttccttttatttcagtaatgcttaaaattaaatgtgtcatgccttttactcattacctttttgctttcagaatcattaccccttccctttacctttttgtggttactagaagtactatctaactccaagtttccttaggctcagcctttgagttatcttcagaattattctctcacctcctgatgcccttatctagacaaggatcaaacatttatgtttattctactttagtatttctggaaatccagaaattagatactctcatttctttcttctacagtctttgtcaaaattcatgtaatatatatggctttgaactcttttaacagtttagcttcctagatatatacttaatttaacccaatggacagtttttctcaagggtagttttgatgactaccttacaaggatcacaatctgcctcaaaaaatatattgtacataatctagccactttctaaaggagctattttcattttttcctgttaccatctttatcagttcttagacagatttttacacaatcatacctattttcagctaccacctagaagtggattcagagtgggatcattgagtagtaggaaaataactgaattattcaggtcctagtcaatggttctgtgacctctagacaagttacttaatctttctgaatatgctcctttcacaaaatgaagatagttaagcctattttgcctactttaggtggtagttgtaagaatcaagtgatatggatataaaagcaaattttacttctaacattagcatacaaatagagttcaaattacttccaaatctatattttcgatcctaattactaatctgttcatgtagaactgtatctcctgaggcacgctaaagaatacccaagtttgaatgtttcactagcaactttagaaaaccaaattcttaatctgcttgtctatactattttatcacgttcttcattcctgtaaaatgaagaaggaattgggttagatctctttcgtttctgtttcctttcattgtttccgtcggtaaacacttacccatccaggttttcctgggttacagtatcatcttacatttcttctttacctttcattctccccatgctagattagtactccagctttattatttcactataagtttataggatccactctccccactgtcccctaccactccacatacacacacaattactacctcagtcttcacacaggaattttgtggtatctatgtgggagtccatctctttttcttctatgcaactctataattcacctgaaaccagcaacagaaaacagcatttttagaagattttaaaaatacatatgaacatgccttggactaccagatttcagttataagctttggaatataaatactcattcctgtactaattacccacctctttctaccaaattttatctcatccaagttctttaagattcaattcaaaattcacttatgaagttttccacatcttatcccaatgtagtcactctttctgtgacttaacatataagtgcaagtaataagatagctttttctttttgagacagagtcttgctctttcacccaggctggagggctggagtgcagtggcatgatttcagcttgctgcaacctctgcctcccaggttcaagtgattcttgggtctcagtctcctgagtagctgggattacaggcatacaccaccacgtccagataatttttgtatttttagtagagatagggttccaccatgttggccaggctggtcttgaactcttaacctcaggtgatctgcccacctcggcctcccaaagtgctgggattacaggcatgagcccctgtgcccagccataagatctttttaatagaatgagttagtactaaaagattttctggaaaagcagaaattgaaaaagttgaaattggcccagtgcagtggctcacacctctaatcccaatactttaggaggccggggcaggaggatcgcttgagcctaggagttcgcaaccagcccaagcaacaatagtaagacccagtctcaataaaaaaataataataatattttttaagttgaaattagcattttaaaatttttttaatttatttttaaaactatgtttgctaaattcaacatagtattctggaagtctgtttagttaaaagtatagttaaaagcttagttaatagtatttaccaatattaatagttttgacaaaaatgcatggttatataggattttaacattaggggaagctgggtaaaggatagacagggattccatactatcttcccaacttttctttaaacctaaatttatttccaaataaaagacttttaaaaatactttatttgtgtaactctggtaaacagttcatttcactcagccactcattttgttgatgaggcctagaaccctaagagggtgagacttcagtatcaccaggcaaattagtgacacatcttgtgcttccctatttaatattttctctactgtctgtactccccacagatcctgataaagcaagcttcataaagtaggtgccaggctgggcatagtgactcacacctgtaattccaacactttgggaggctgaggcgggagggtggcttgaggccaggagctcgagaccatcctgggcaacatagcaagaccccatctttactactactactactactactactactactactgctactactactactactactaataataataataataataaagtagatgccagttaatgcttttgactgacccaccttcatagtcctattcacgttctcaaagtttaacacaactattatcatcccataaaatcaagagacacttatgggtatacatacatgtatagtagcagtttgttttaaaaaagaaaaaaaaacctgctcagtttcaagttaatagccagctgtatactggatcatacaaagaatcatttttaagttcattgtaaatgaaacacagtaccaagactttaagacagtattagagtgaatacagtattacatttcctgtgatttaacagaagcaaaataaatatagtaatagttttttttattcagacttcgagaactttgaaaaggacagaatgttacaattttatggagattacttaattttactttaattcaagataggagtaattgtcatcctagtggttattagtttggttttagaaatgctaaggtagttgttaaacatatataattttaaagcaagcttttatataaatgcctacatataatctggtacctttctcaccaatctgtaaaccttatctaatctctagatttttttcgctttaacaaaagtaacttgtactcataaaattattccagtagtataaaaatatataaaacataattgaaaccacatgtttttttctgtcacaactttctctgcgtctcaccacacttacacaaaatccccaaagataacaattggtacatttgtacagtacattttcagacatttttgtacagttttataaaagctaactcaactgcaatcacagtgtatgtactgctttccagcttcacttttttctcctattacgtagcacctgtatattgaggaaatcttcagatgttagcgcatgtatgtccacctcatgttcttttttgagcacttgcagaataatatgttcataggctgtgttatgtaccatcatttaggtagtcagtgccctatagttctagttttttgccattaataatgctgcaatgaacattcttaagtgtgtatatttgtatacatatgttaagtttataggatattaccctgaaaaaaaattcctggatgtagaatttctgaatcaaaaagtaaacacatcttacattttataatgattcactagttgctatacacaaggattgaacttacatatactgttaccacacttagagagtgccatttctccaagtttttaacactagatagtattagctttttaatcttcccctatccagtagatgaaaactgggattctgttttaatttacatgtatttatgaatgcagtttcacacgtacatcattttatatgttgtccatttatatttacatatctttggatgtcgatgtcctttgctcatttttctcttgagtttttgtcatcctcctgttgtaaaaacattttctaagctgaggaaatgaaccctttcaaacatgttacaatggtctttttaatcccagtttttttcttttgactatgtatggtgtctacgctaatagttttgaatggcctggtttttaaacttttgtggaacccatctcatttgttgtggaacccacaacaaattatttgcaatgggcaggtttatatttgtgagccattttatctatataaacagatacattttatttaatcttgaaacctcattagatatttcactgctcattgtatacattacagttgttttaaagaacttttaaatgttgtatttttacaggcctccgacatccaggcaaggacagtagtacttacctggtcaccaccttccagcctcattaatggtgaaacagatgaaagtagtgtaccagagctctatggttatgaagttctgatctcaagtactggaaaagatgggaaatacaaaagtgtatatgtgtaggtatttgttgttttgctttctcccattgtgtaaattaatggtttattataaagagcttattactaattttgctctacttttccttcttcacgcttttattctgaatctttaagttggctaatgatagtgatttcaatgtaaatggtccaaatgtagcttggtacacatttctgtctaccttccttcagaataatcacttttattggccacattcagctttttttttcccagtaggctccctaatagatggttcagtattcacgtattcttaatgcattaaatataagttgtagtatgtagaacccatgaccaaaaatggacaattcatgattgtaaactcataaagtatgacattgctcctctaaggactggatttaattcttacatgtacaagctcatgtcctgttgtaaaatgaatttagtagcactgttatttatttgcatgttagtatgtttatagtcatattttgaaaacttacgtatttctttccttggtttaaaagtatattacacacagccaggcacggtggctcacgcctgtaatcccagcactttgggaggctgaggcgggtggatcacctgagttcagcagttcgagaccagcctggccaacacggtgaaaccccgtctttactaaaaatataaaaattagccaggggtggtggcacatgcctgtagtcccagctacttaggacgctgaggcaggagaatcgcttgaacctggcaggtggcagttgcagtgagccaagatcgcgtcattgcactccagcctgagtgacagagtgagactccatctcaagaaaaaaataaaagtatattacgcaccacgaagccttagaaagattcagtagctaaagttgtgacatttatgattgacagttttgaaataaattattctgtccatattc

SEQ ID NO: 8 - DNA, 7096 bp, Homo sapiens
tttatgaaggagagatctaaagaaataagacttgttattggtatggacttagaggtaggatttctctcagagcaaggaggtttttcaagcaaattctgataccaacctctttcctttggaagtaggaaacagagtccctagagacaatttacttcaacttttgggaactttgaagatcagtctttgagaacttagttgttgtctagtggccaactagatgttgtgtttctgaataatagaaattaacaggtgaacttggatgtcatggattaaaaattaagtgtcagtgtagctactgtaggagcactttcatgtactttgttgtttctgcttccagggacctaatacctatcattgctgctctggaatataatcagtggttcacaaaactgtcctctaaggatctaaaactggtaagtaatcaaacatgcagcaaatgttgcttggctttgctgaatttcaaaaacccaataattgtgggaaaaaaacaatttttttactgtactagtaagctgtatacattttatttcttgaggaggtattttcctttaaatgatttgcgtaacatttagtcaaatttgtaatgtgagatgcttccaagtatttcctcatgtattcagctgtttcgggcaatttaagaagatgaacaaaaagatacatttagtgtagcctttagtataaagtcattcagttggcaaaaactgttaaagttacatttgcacagctgcaaatagcagattttatattcctatcttacactctgtctctacaaagtttcccttcctaggaatttaggaaaacattaacaggtagagttcccctggtcgagtaatgatagttaatgttgattttctagatggggttttgggtagatttatatgaaagcaaaatgaaattaaagtgaaatctgttttcataagatatgaaggagaaaaatatttggtatattttattagtggaaataagatgctgtgttggggttgctgccagttcatatcagtcatatggacagatgcttatacataaattaactctctggtgtttgttatgggataagaaagaatttatatgttttcctggagactctcacgtttaagcctctaactttcagaggtcatagaatctaggggtttaagattttcatagtgaatacatcagacttggaatgagacgtggatctgtaggacatggagggttgagactggctagtgggcaggcgacttggttctctgaatttgcctggggtaggggtggcctaaaacattataagtatgaaaatggactaaactcatttggggtcccttaagagccaatatggtagaggaaaatgcatgaacttggaataagaaacctggatttcagattttaatttttattacaaggctgtggtaccttagataacttacctgaccttccagggcctcagcttcctgcacacctgttattgtgagctagttggaaccatttcttattcatctctacccagtgcttatgagaatgtgtggctcatagtaactatttaataaaaattggtttaataagtagatgtctaataagttatcaaagagattgagaaatgaacaaatatgagagtatgaattatgtgaactatataattcaaacaagagttgtgtctgagaagtgatgatggagtgagagttggcatgagttggatccaggtgagctctcagggagcagacaggtagccattatgggagacctaagaatagaagtcccttgtttgctgcttgctgggatgggaccatttccaggactgagccagcaaagagtacaggtgggaaagaggagccactggaggaatgagaaggagattagtccagggattgtgggaacagagagaacaatggtttgctaccatgtcagtttttctggctcattcaaacatttacataagcttgtgaatttcaaaatggggcctcaagagggtttcaagaaggttgtggatatctcacttttggagagtgtcccaacctgcaattacaggaaggtgtccaggcaattgctgctgccattctgtcattattcctcccaggtatcatctcctttcagctgccttagatgtttaggacataaaatatgtacctaatcatttcagtcctggcaaaacaaaccatgtaagtgctagtatgctttcttgggtgtcctgggatggaaggaagtggagtgacaggatgtgagggctgcttatgccacttttctgttaactgagatttaaacacaaaaatacagtttgcatatatttttaatatttggtattttaaaatgaagtgatctttgtggatattactctacaggtcttcaaaaagaatactaaattcttgatgttttttacccaaagttaaaaagaaatgatacttccccttttgattggtactgaagtgggcagtctcagagcactgtctaacattgggtttattcaaagaaaaggacaatgtgaagaagcacatctttggattttgtaaacatgaagtgcaagggcaaaaataagtggctgcttctcaagttatatgagctctctgggttaagattgttcctagtccaataaaagcctcctgtgctaaggtgccacaggaaaaatatgactttatgttgatcttatgaagcaaattagcaatcactatttctaatttgagtcaaggatttttaaaaaaaaaaatggtaccgaatatgcaattaggaccatgtttttggccaacattcttgattcattaaaaaaaacagcagaattggggtcttgctcagcttcttctgttttgcaattcaggcaaattggtgagcatctttttttagtctttagggaatgacatgctggcaccagataatgtatacggtttctttcagttctaaagttccattttttaaaaattattttactttgcaatagttcatttattactctatagtgattctagtttttgttgtttacattccatttttaactgagtgcaagctcctggagagccactgtatccagtttttaaaaaatttcctaaactgatgcacgtagtgctgcacatgctgtagacatttggataacactgttggaattatcacattatacttagtagctaggtttgagtgtgtctccctttaaaagtttcatttccttatattcatccctgtagaaaatgatgcttttaatgtacttggcactcaataaaaattagtagaattaatttaatcatgaatgatttgttacacgtctcccctactggcattttaaagaaaagttggagacactttcatacattttccttaataaatttgtattacagtatttataccccaatgagctataaatcttcaaagcattatggtaaattacttttccgggtgcactgcaaggtagcccagaaatggtaatgatcccaagaattatttctggttattaggataatcgctgcaaaaacattatctaagtaatcactttttatcatgacaacacagaataagaccaattcctttgtatgtacattgtgagataaagaattatactgataagggtgtcaccattttgaatatcatcactgtcagcataatgtaaattgtaggcatcaggtcaattggaattaatttttctctttcctcctaaatcagtgggacacattagaaacccagcaatagtgtaaaagtggcattatagacagaatggaatcaaacagcaaataagaattatgagagccttacatgctgtggtacttggggtgtatccaagttaggttttcttaaaaatacttggctagagaacttgtgccacattcagactgtgttccaattatggttaatccagttgggtatttgtgatctgataagtcaaagtactgtaatatttttatgtgctattttaagaaaagaaagtgctttgatattatatgctgtggcacatagaacatgccttctttctctcactcttttttctaaatatcatgaagtatttaatacagcctaggttgcaaggagaattttaaaatcactttgtgtgtgtgtgtgtgtatgtgtatgtgtgtgtttgcatgtgtgaaacggggtctcactctgtggcccaggctgggatgcagtggtgcgatgacggttcaatgcagcctcgacatcctgggctcaagtgatcctcccaccttaccctcctgagtagctgggactgcaggcgtgcgcagtctgggaccccaccccactactttttgtatattttgtagacatggaatttcaccatgttcccaaggctggtcttgaactcttgagctcaagtaatctgccttcctcagtttcccaaagttctgggattacaggcacaagccaaaatgactttttaatgtataagtaatattaaggtcaagaaccactttaaattagttttggaatgaagcaggttataaatataaaaacattaataaagaaaaaaatgcccaattctaccaccagggcacaactcttcatttttcactgtcccctgaaaattttgttataagttactcattttaattgttgtaatcttgtttaacatatatgcataatagttatataactacataatggtttttttgacattttttattacatgagacatgtttattaacatgagacaattatttattaagctttttcctattattaggttgtttcccactttatcctatttatgctccagtaggaacatcctaataccagttagtgttcatcaagtacttatttagccttcctattaagtttatgacatctttaaaccttaattttcttatctatgaaaatggaataataatctttaatggttttataatgaaatacacatagagggcttaactcagtgcctggcacatggtgagaactctgcaaagatattttcaacatcattatcataatcactaacacttagtcttcagctctccattttgaatgtcactttctttgggaagtcctctaagtttcatgagcctggattaggtgcacctatatgtatgcatagcactaccaaaatggtctttttattattttatcataattgtatatttttatcatttcattcaggctgctataacaaagtgccatagattgggtagcttataaataacaggtttattttccagttcttgaggcagagaagtccaagatcaaggctccagcagacttggtgtctggtgagggcacagtttcttgttcacaggtggtgccttttagctgtgtctttactaagtggaaggggcaagatagctctctggggcctcttttacgaaagcactaattccttcatgagggccccaccatcatgacctagtcagttcccaaaggcacctaattgctaatgctatcacagtggggaaattaggtttttaactgtgaattttgggaggtcgggggacacaaactctgaccatagcattcttcttgtctgtttcccctgctggatggcacactcttgaaggccgggactttctcctttatatcattgtatttccaggatcttcatcacgatggtgcgtagtagtagatgctcattcaaggtttattgaatgagtgaatgttttacttaattaaaactttgcattgcatagatttataacaataaagtttttcttctttagagttatggaatagtcaaagaatgttttctgttacagtccactgatgtctgtgaacagatcttgagggtggtgagtaggtccaatcgactggaagaattggtgttggaaaatgctggacttagaacgtgagtattttcctgaatatataaatatgttgctttaaaactctgtgccatttgctcttctaattaattcatagttttttttttttttaattgggctgatcacatatacagcaatgtttttccttctgggaaaaaaatatccctataattgccatcatcatgaaggctaagaatttggtaacatctcttgataacggtgtcacttgatatttttgagagtacatagtatagtttttaagagcatggatccttgagccagatgtctcctggccttgcacaagttgtttacgctttctgtgcctcattctcttcactcttaaaatggggataataataatgcctattttatagaattaaaattgctagggtaaatgaattaatatatttaaagtacttggcaaagtgccttttactctgtagatggtatatgtaggtttaattattatcgttactggtggtcatagtgataacatatttcatatgactttactgctttgctttgatcagttttagtcattttttctcccttttcaggttaacacttgcatagtctttatctagtggtttagtagtcactacctaagcctactgttaagagcataagagttagaacctagtagaataaagattttactgctaagtgaggagggttgacagtttcataatcatagcacttagtacattatttgaagttaaacataactaaaacagtggttttaatttttgccaaaatgtagcactagcaattgtaacctttaaacttaataattagtgtaatcagttttgcattcacaattgcatggaatgagaaataagatgtggtgaatactataattttcatgaaaagcaggttcaatccaggattttttttttttttaaattatggaggggccagaaagtactgttaatagcacacaacagagtgcctttaaaggggcaattgtatattttctttttgcttttggccaatcagaatgaaccgttttctggctgtggctttacaaattctctaatgaggtgttaatgggtattaagaaatatatgctatatagactaatattgtaagggaggtttctctatttagatttcactctgttctaagctttaaatgttccgttcgaatggttttacattttgttatttaatcttattgttttgtttacacgcagagattttgcacaaaaactggccagtgctctagcacataatcccaactcaggactccacacaattaaccttgctggcaacccactggaggatagaggtactgcagagttctcattatcattgatgccagaattgtaagaggattagagaattttaatttagccatgcctgaagagctgtatcaagctaagttgtaattataagtgc

SEQ ID NO: 9 - DNA, 43093 bp, Homo sapiens
ggagggagtgtgctctgaggggcaagggctgctccgaagccctgctaatgtctctgtgtggccatgctgtattttcagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattgtaagtacagaaatagactttcctctttattgtcagatacccaagaatattttctgtctgctttttctcctctttcttctcttcctgagcattcaccagcagttttatcagtggcatcctatttcagccaaaacagagtgaatggagctctgcagaaaaactcattaacataggtcttgtcttgtatgggtggcttttgtttttcggtatctgaattttaaaaagatgtttttttttaaaaagcatgtgagaatgttataaatcaacaggtatgattggctaatgtgttaagaacagctattgtcctcttgaaaaaatatgctatgagttgcaagtattcacaagagattctgaatgtaagtgctggcactgatataatggctgagattagagtagaatagaatccctcaggccgatatttcctgctgttctcattgaacttccgtagacaccagagatgagagaaattgcttaacctgaagtttgctgtgattcattcttgatggctctggctctgttcacattacatcacattaaattaagttgcaactttaccttcatatatttcattttccctttcatgaggcaaaaaatgggccacacagtcctctacagagattgcttaacagcataaagtttgcagatctgtgttacctggtcaagtgatttaacacttagacattttaatttttattttttaaaatgatatttgggggagttttaaattaagtgtttctgcctaaatatgccataaggtcagattagtcaggatgtgatcttagttcccattcccctccttctcttctaacagctgactccctgaacgctccctcctcccctacctgccctctattcggcagtaataaaaatactgactggcatgccgaggaatatagcaattgcttagatattcagttcgaatattagttttttgtgccaatgttttgcttgctttcagatgagaaatggaatagaattttgaagataaataatatgggcataataaattcatttggctcattgaccccaggctctacaaagctctcccttaaatgataggactgtgctgtaaggactaagatcagcattgatgagccacaacatgatgtatcagaaggactaagaaacaagctttgctgcctaacacacctggattcacatcctgactttgggcaagtcacctcactgttccctcccatacaaaataaggacaactgaatgcttacctcatgcgttgctgtggggcttagaaatgacttagcgcagtgcctggcatttacgaagtgttcaggaacagggaaacaaaaaacctggctggaactgctctttgccctctttggaatcacagaccaacttcctacttctgaaaggaatgaaattccactgagaaccctcattaagacctcttctctccaattctagagtgaagggagatatgcccattcctcagaggaagggtaatctctgtatgtctcttaccagcctacagaataagagaaagcatacaggacacctttccatgtacctcacaatgtgacacactccacaccccacgtaaaactaggaggccagactcggttctgtctggtatggtttcatggtggctctacctggaggctgtgggctcagtctagaattgggtcctggtttcttcctgtctcataagcatatcgctttcctgtgtattcagacaggcatccctgagtgatccattgacttactgacatatttcctctcttcttcccagtctcaggaaatttcatttatcgttgcctaggttctcctttagttactttttataattatagagattgttttacattttaaaaaaatataaaaaagggaaggaaatggattaataaaaattgtggcagaaagttagtcagaaaatagaattaataaattaaatgtacatctgcctggctagtctataatagaaagtcagacatacaaatacagttaagaaaacatatacttaaaaatgaaaatataaacttaagacttatttaagttgtatatacaattctgtgccaataaatgcttacatctcaataaaattgaaaactctatgaagatatttactagtgatgccttatatcaaattttttaaaagatgtagcaaagctgaatatatgaatgccaacagaataaaattttaaacatgccaaaatatttctcaaaaaatagtactcaggacacacagctgtggaataattttcctcaaacatttgaggaataagaaatctcaaacaatataaaatgtttcaaggccttttcataaatgaaaaacttttccgtgcatattacaaacaagaaaaatatgtatgtaaagcgcttagaaagtgagtccacataaatacccacaaaagcactctgaatagtaacaataactcacttagcagtgttgatgcaagcatataaaaacaaactggtagatttgcctacctaagaataaaaatttccatcagaagtaaagactgcaaaaaagtttgccacataggagactcaaatgtaaatacccttaatacttaaaaagatgagcttcccaaaatcaaaatgagagaggacaagaatagacaactaacaaccagcaatcaatagactgtgtgcatataagtatttctaaattcatcactaaccaaagaaaaatcattttttaaaggatacagcatttttctcatataaaattggcaaatgttttcaaagaacttagtctatgtttacaaaatgtagagactttcatgtaattctagtcaaagcataaaccaatattttctttctgaagagcagtttgttaaagatgtattaagagcttaataaacttcagacccagtcattaattacattttctagatttataaaaatacaaagatttgtatatagggatgttcatgtcagtaatagttttaataattagaaactaggaactagctaaatacacaataccagactggtttaatacattatgtgccagccatgtttttgaaacaccttaagtaatgatggaacatgtttgtaatttaatattaggattttttaaggccaaaaaattgtatgcagtattgtgggtaagatctttttctcttctgtaagagaatctgacctcacaattttctgcctgtttcccctagaaaaagataatatgtatcaattatgtcaccaggtaaaattgagcccttattggtgaattgcatctgttctcagataactgttatgacctgagagagtgcttctgctatgacttccaataacagtgactctggtaacttggcatatctattgtggatccccggaaactatgcctatggagttgttacaccatatattgactcctacagggcatgtggcttttcagccagggtaattcctgcatcctctgaaatgtatgtagcccccattcacctgagctgtattgttctgctggaccactgcaaggacatgtgctaaagataagcaggcaatgctaccctgccggcaagctgtggtttcttccaagtggaccagcaccaaatgtagtctgtggatctgaatatttaacatatcctaagaagatacattgtggatgttgcaagtataatcccaaatttataattataaaaggaatagaaagaaagtaaacattttcaactattatttctgaatggtaatgttagtttttgttcttcatttatacttttatatatttctttccaaattctacatgaatgtatattggttttaaaccaaagacatacctctaaaacaaattatatagtccatttcttttggcaataattacaaaatgaccaaactttaataagacttgaaaatggcaattctaataaaaacatacatcaccaaaactttacaaagaattttctctcctctcagagtaaaagtgataggtcttctttattttaagattttcagcagaagctcttctccaggctacagcttttgatcttatctcttccattaattcattttccccaaatgacacaaattgaaatgtagtacaactgctcccatggaagtcaatgtgatttggtcagtggacagagcattaagcacctacagttctactctagttctcgattatgaaaccccgattcagctttttcattcctttgataatactgacaaaccccccaaatatattacataaatgatggtcacaagaataacatcttttaatatacttatattctgcagacatggcctaatttatcctcagaacagccaaagaacatagagaaagtgtgtggtccaatttctttcattttgagttgagactgttgagactcaagtaggttagatgatttgctgaaggttccacctggttctgtacatgattagacagccacccatttggttccacttattttcctcgcaaatgaggggcattggtaggaaccagggctgattgcagctgataggtcaatggcaaagagcagcgtggccttgctaccctgctaatggcgcttgattttccctcaagacctaaaaatacatgagcagcagcaagacagaaaacagaagaccttttctgataatgctcagggaagtttcatgggaacagtttcctgggaacaaggagttgcattcacttctcctgtcctatcctggtgaggtatgacctgttgcagctcccaagtgcccacctcagcacacactcctgcttctgagtatgcatcctccactctcctcacaatgcagtcatcttttcccaggtttaataagactagagaggcaggtctcatgtcacagctttgcccccagtaactgtgtgacctctgataagccatgttccttctgtgggttcagtttcctcatctgtacccaaaagaaatggttaggctaaatgatctctaagcacctgccagttctcagattccatgaaaactgaaaaatgaacattctcatcagaagctaacatttggaggcttccaaactcccaaatcatgactctctttctggagtttgattttgcacctctgtgccggattaagtgtttcacagaactgcacagttgtttattccttcttaaaaccatttcctgttctctatggagtataatgaagcgtgacgcctcttgggtgatctgtgagacactaactaacatcaaatctcaaaagtgtagctcaatgtggacttgtctgtccttggttttctgtgctccctcaagcacattgaccatggaagaacctagcaccctgcactgctgcgcgtctgcagatgtgcactaatgaccccattcacaattgcagggatgcacaagaaatgcttgaggggaaagactctgctgtatattcaacctgtcatttcctatttctccttttgtgctttgctgtcagaaaagatcagcatcatattgagacacggccacatgggataaatcgcaaaaggccaaggccactgctgtcccagatcttcaggaaaggttagagcatgggggatttactgtgtccccgtttagcccaaagtggcagtctatgcttgaaagaaatctgcagggtatgttctgaccacctggaaaccctggctaactactgcctcaggccttctgaataaactcatacactcagagtcaaaggaagagagcctgtttggataagaggatttactcagcagagaatctgatttaccctcattttatctcagccccagcagcacaaggcatgaaaaaaatggctattaaaccttttttcttggcttcacaatgaagtgacaggggagtatttagtattgaagtagcagaacatgacttccagcccgaggattgaaatagctcacattttgtatgcaagtgtgcgcgcatgcattacaagactcatctagaatttcctaggaaaggaagagacaaacacaacttgatagaaaggcacaatttggagaaaattgtgaatcttcatttgggggtttctgggccgtaagctcttccagcaaatgtaaaaacccagagcacagtgcagatcacaaagtgggctctcaataatgcaagcctgttggctggctgacgaggggtgcagctgccgaagcaaaggagacattgtagggtcttgtacttcctcataatctgccttttccaggctctgaacaacctcatctgttgaaactctttataacattttataattcacatcttttttcccttttgtacattatcacatgacttccttttttaaaaaaaaattcacaacattttctttgttgctaatatattcagtgtttataatttacatttttctggaaaaaatttctagatatgcccattaattattgtggattttttaaaaaacttaaatccattttctcattttctgtccatactgcagatgactgctccaaatctcctttagagattgtttttctcctgacatcatgccaccaagagatatgctttccatcttcaatatacccctcctaataattgatgactagatgattatgttaaggaacttgacaatttgtttcttggagagaatattgtttgcctaaaaatatgtgattttcaatgcattttactttttactctatttttacttcaatgcattttactttttactgaaagtagtattttagctaactcatttaaaattcccatttctcttgtattcactgttcagataaaaagatataagagaacactatgctttggaaatatgataccgccctggtgctctattttatatcaagtgccacctaaagacaccttctgaacgggtggatgtggcctctggagtaagaccagtagagaggctccagtttacaaaaacacttattatcccatttactgaactcttttcagaatcatccaaacagccttggttccatttaagccttgagctttgaaacgcataggaagtgtctagagctgaattgcatcatttacacctaagagctcttgaactagccaaagttctgcaagtaaggggacaggaagctctctgcaggtctggggttatcaatgtgacagcactcatcaggaaagattaaagtggagcatggagacattggcagttagggctagcagcagggtctataggttgaaaatctcctgggtaacttttaaacaaaatctaaaacaaaaaccatttctgccttcttggagatgtttattactattgaagcctcccagggagaatattagaagtatctaaaaatccgtaagactgagagccctgaaactacttagagactaatattggggagtatataaagaactctctcctcttcctcagagtgttagaatatctagagtgtgggcaaaatctgatcaccagcctctgctgtcctttaacaacccaaagtgacagagatatcagcaaatgtgatgacttggggtaggctgtgtctactttgctttcagggaaggttacttggtaagggtgaaggcccatgggattgtagaaggaaatgatggctgaaggaagaagcaatgcaagaaatcacgctggccttggagagcttaactgactgaactgcgattgaagcccagttacatgatttcagtttcccttaacgagccctctctttttggctcctatcataatggcaaagatgttggagctaaaaaagcaccttagggatcctgtagtaaaacttcttcatttgacagatgagaaactgacacccaaagaggtcaagcaactagtccaaaattaaacacctggttagggcagagtcgagctagaattacactatatttccttactccaggactgggcacaatgatttctttctcctgtttcaacacacattcttgcctgggtagaccagcaagtacaaacagaaaacataggacatatatatatgcttttacattcactttttaatcctctcaacaactatgtaatacagtcactactttcatattcaaatcattagaaaaagaaaaactgaacctcaaaaagtttccattagttacccaaaatcacacatcaataaaggagagagctgagatttcaactccaaagcccgcattcaggaaacagcaaaaactttgatatcacccagtactagagccacaactagcatatgtatgaccacaaaatatgtattctgggaattctaaatgcccttttaaattgcaaccacatataacatgcagtgaaatttccttaaaatacaaaattataatacatctttcagtgactagttttttccacagactgtttatattctgaaatctaaaaacttcctctaaactttttgtattgatatcagttatttattgcgtaccacatgttttttaaaatatttgtgaagaagagggatggagcaagttggtggaatagtgctatccagtaatcataccccctccaactgaaacaacttgagcagctatccatgcgctaaaatagtaataccttcacaagagctaagtaaaccaggcgagagatcagagtaactggttggaacacaataataataaaagatgcattgaaaatggtagaaaggagaattttacattacctgcaccacccctcccccaaccatcacaacattgagagagacaccatccacttgggggaaagagaggggtgtgagaacaggactttgccttggaccccaaccctgggcccaccacagcgaaatccagcatcaggcaggctggcaggcacccacagccccagactccagagtagtatccacaaactgagtcccagtcctgggtgggaccctgcagtcccagacttcaagcctgtgaggcagagttggtctcccagttgtactaccgctggcttgacttcagtgtctataggatctggacaggccagagcagcaggcaggcctcagcagccccaggttttgggcataccccacccctgtagtgaccctgcgattcagaaccaagcttaatggcctgtccaaaatctctgaatggactgttgaagagcttttccagcaaagccaatctgcaaagactggaataagtacctacttctacaaatgtgtatatctcaatacgcagccccaagaacaatcagtaaaacatgatatcaccaaagggacaaaataaaatgctgctaactgaccataaagaaatagagatgttcgaactcactgacaaggaattcaaaataactgtttttaaggaagctcaatgaacttcaagaaaatacagaaaaacaatacaagtaaatgaggaaaacagtaagtgagcacaatgagaaatttaacattatatttagcattatataattataaagggattaattcagcaagagaatgtaacaattgtaaatacatatgcacccagcactggggcatgcagatatacaaagcaaaaaattattagagccagagagatagacctcaatgcaaaaatagctggtgatttcaacaccccactttcagcattggacagatagttcagacagaaaatcaataaaggaacattgatcttaatctgtagtatagaccaaatggacttgatatttataaaacatttcatccagtgggaacacaatacacattctcctcctcagcacatagattattctcaaggacaggtaatatcttaggacattaaaaagtcttaaattcaaaaaatagtcatatcaagtatattctctgaccacaatggaataaaactaataatcaataagaggaatgttggaaactatacacacacatggaaattaaacaatacgttcctgaatgatcagtggatcaatgaataagaaagaagttaagaaatattatgagtcaaatgaaaatagaaacacaacataccaaagtggatggaatcaagcaaaagcagtactaagagggaattttatagcaataaactcctacagcaaaaaggtagaaaaacatcaaacaaacaacataatgatgcatctgaaagaactagaaaaacaagggcaaaccaaacccaaattatgcaaagaaataataaagatcagagcagaaataaatgaaatttataaaacaatacaaaagatcgattaaatgaaaagttggttttttgaaaggataactgacaaacagttagccagaccaagacgaaaagagatgactcaaacaaataaaatcagagatgaaaaaagagacattgcaactgataccacagaaattagaaggatccttagagactactatgagcagctatatgtcaataaattgcaaaacctagagaaaatagataaactctagacatatacaacttaccaagattgagccatgaggaaatccaaaacttgaatagatcaataacaagtaataagatcaaagtcatagtaaaaagcttctcagcaaagaaaagcccaggacctgatggtttcactattgaattttaccaaacatttaaagaagaactaataccaattttactcaaactattctgcaaaatagaggagcaaagaatacttccaaacttattatatgaggccagtattgcccttatatcaaaaccagacaaagacacatcaaaaaaaggaaaagtacaggccaatatccctaatgaacatggttgcaaaaatcttcaacagaatactagcaacaacacattaaaaagatcatttatcatggccaagtgggatttatcccagggatgcaaggatggttcaacatatgcaaatcaatcaatgtgatacatcatatcagaatgaagaaaaaaattatcatttccattaatgctgaaaaaagtatttgataaaattcagcatcctttcataattaaaaaccctcataaaacggagtatagaaggaacatacctcaacacaataaatgccatataaaacagacccacagctagtaacatactgaatgggcaaaaactgaaagcctttcctctaagatctggaacatgataaggaagcccactttcaccactgttattcaatataggactggaagtgctagctagagcaatcagacaaaagaaagaaagaaggaacatccaaattggacaggaagtcaaattatccttccttgcagactatatgatcttatatttggaaaaacctaaagactccaccaaaaaaaacctattagaactgatacataaattcaataaaatttcaggatacaaaatgaacaaacaaaaaaatggtagcatttctatatgccaacaatgaacaatctgaaaaagaaatcaagaaaataatcccatttacaatagctacaaataaaatacctaggaataaacttaatcaaataagtgaaagagctctacaatgaaactataaaatactgatcaaaaaattgaggacacaaaaaattaaaagacatttcatgtttgtggattagaagaatattgttaaaatgcccatactaccaaaagtgatccacagattcagtgcaattcctataaaaataccaacgatgttcttcaaaaaaatagaaaagaaataattctgacatttatatgacatcacaaaagacccagaatagccaaagctatcttgagcaaaaaacaaaactggaggaatcatattacctgacttcaaatcatactacagagctataataaccaatacagcatggtgctgccatgaaaacagacacctaaaccaatggaacagaatagagaacccagaaattaataaaataagaataaatagagactagaaaaacaatagagaagaacaaaatgaagagttgcttttttgaaaagatagactaaattgataaacctttagacaagaaaaaagagaagattcaaagattcaaaatcagagatgagaaaggaaacattacaactgacactacagaaatacaaaggatcatattagactattatgaacaatgatacaccaacaaattggatagcctagaagaaacaggtaagtttctggaaacacacaccctacccaagattaaatcatgaagaaatagaaattccaaacaaactaggtgattgaatcaataatatacagtcccccagcaaagaaaagcccaggagctgacagctttgctgctgaattctaccaaaaatttaaagtaaaactgatatcgcaccttttctaactctctcccaaaaaaattgaaaaggagggactacttccaaattcattttacaaggtcagcattcccctaataccaaagccagagaaggacacaacaacacaggtcaacattcctgatgaacatagatacaaagatgctcaaaaaaccctaacaaatcaaacttaacagcacagtttaaaagaccatttaccatgatcatgtgggattcatcccaagggtgcaaagatggttcaacatacacaaatcaataaatgtagtacatcactttaaaagaatgaggaacaaaaactatatatttcaataaatgcaaaaaaatgatttgacaaaattcaatatccttttacgatttaaaaaaccctcaacaaattaggtataaagaaatgtaacccaatacaatagaggccatatgtggtaaactcacagctaaattcatgttcaacggagaaaagttgaaagttttttctctaagatgtggaataagacaagggtaactctcaccacttctattcaacatagtacataaagtcctagccagagcaatttggcaagagaaagaaagaaaaggcattcaaattggaagcaaaaacattaaattttccttgtttgcatatgacatcctgtatacagaaaaccctgaagactctactgaaaactgttagaataaactggttcagtaaagttgcaggatataaaacaaaatacaaaaatcagtagcatttctatatattaactgcaagctatctgaaaaaaagtaaataataatcctatttataatagctacaaaaaatacttaggaatttaaccaaagagatgaaaagtatctacaatgaaaagtataaaatattgatgaaagaaattggagttgcaaaagaatgggaagatattctatgttcatggattggaagaattaatactgttaaaatgtttaatactacatgaagcaatctacagattcaactcatttgctaccaaaatatcaatgatacattttttatagtgatgggatctcgctctgttgaccaggctagtcttgaactcctggcctcaagcaatcctccaatctcagccttccaaagtgctacgatcacagccgtgagccaccacacccagctatcaatgatatttttcacaggatagaaaaaacaatcctaaaagtcatcaatcaaaaaagacctagaatggccaaagcaatcctgagcaaaaagaacaaatctggagacatcacactatctgacttctaaatatactacaaggctattagtaaccaaaacaacatgctattggcatataaagaaagaccaatggaatagaacagaacccagaaataaatccacacgtttatagccaactgattttcaacaaaggtgtcaagcacacccaatgggaaaaggtcagtccattaataaattgtgttaggaaaactggctatccacatgcagaagagtaaaattaagactttatctcacaccgtatacaaaaatcaactcaaaatggattaaatacttaattgtaatacctaaagcaatgaggtcttacatagaagaaaagcttcatgacatatgtctgggcaataattttctggatatgaacccaaaagcacaggcaacaaaagcaaaaatagacaaatgggattacatcaaactaaaatgcttctgcacagtgaagaaaaccagcaacaaagtgaagagacaacctacagaatgggaaaatgtatttgtaaaccatatgtctaataaagattattaaaatataagaaaatcaaacaactcaatagcaagataataacccaatttaaaaatgaagaaaaggcctaaatagacaaaagacaaatggccaacaaatatatgaaaaaaaatgctcagtatcactaatcatcaaggacatgcaaattaaaaccacattgagatataatctcacacctgttagaatggctattatcaaaagatgaaagataaatattggtgggaatatagagaaaagggaacacttgcacattgctggtagaaatgtaagttagtacagccatcgtataggaatccatatggaggtgcctcaaaaaattaaaaatagaattgccattgatctagtagcaatctatataccactactgagtgtatatacaaaggaaatgaaataagtatatcaaagagatatctgaactgccatattcgttgcagcattattcccaatagccaagatatggaatctgcctcagtgtctggatttaaaatgatgtgacatatatgccattaaaaaggcaattctgtcattggtgacaagatggataaacctagaggacattatgttaagtgaaataatccaggcactgaaagacaaatactgcatgatctcacttctaattgtagatgtggaatctacagaagttgatctcacaagaggaataagttcaagagatctattacacaatactgtgactataattaataaaatatattcttgaaaaattccaagtgaacattaagtgtttgtaccacaaaaatgataactatgtaagatcatgcatatgttaattagctagatttattaacatcacagtgtacatacactttaatgcatgtgttctagagatgcttcagatactatctgtctgtgtgtgtccgagttcctgaaacccataaagggagaacattataaatgattccagttttgaaattttatactttttaatttctgttatccatgtgcctttcattatgtcatcatctttatccatctaaacagacattccagcatgacaggagaaatataaggtatggaattaaaacattaataaattttctctaaaatcacaggtctatgtacagcaaagatgatcatctatgagatcacattattctggggaaatgttaaaattaggattaggaaaatcaaaatggcatatgaatagtgggaagtgtggactttggaatccaattgacgtgtatactaattcctgtgccccatgcaccatccatatgctttggagggtaaattacctaaacttgctaaactgtcactcctcaacagtaaagcaaggataattatgcctgcaggagggatcttgtgagcctgaaaagactatgctgaagtgcctaacgcccagtatttaatagataacggtaattaaccttttacttttccttgatgagtctcgatcttcagttatggcagtgtcattgttcatgaaaacttgtctctaccaattccttgttttaaatgggaatacactgtgctgggtgccataaggatactaaagagttattaagatgtagtccctgctattagggggcttctaatctacctaagggcattataatttaaagggtaacatatatttattagtttaacgagagagatgcctataataaagaagggctaatcaaccagttcagggtaggagaaatatatctgaggcaattgtgatcaaataagaatttagaatgtaaataattgtaatggcacataataaagtaatgcagttgagtaaagtcctcacttaatgttgtggtggataggttcttggaaactgcaagtttaagcaaaacaacatgctatataacaaaactaattttaccatagactaattgatataaagaagagttaaattcttatagcatacagtatgtcatttcacttaaagttccagttttcacaaacctgttgatataaagtgaggtcttactgtcacctcttgtgatgtgtgtatataatgccttcttgggcacattggctgtctgaatcattcctcatcattgctactcacacagaaagttaaaaaagaattcaatcccagcatgaaccttgtcataaattctattacaacttattatttcaatttgtttccatgtgaccttagattttaatattataggctgaaactctatctgaaatgatcaattatcactttctctaattcttttgaagtgttaaatgcaaattacgatctaattcaccatctctctccaacatcttttaaaatgattgtgggtcctcaacagttttgttttgtttttaaagccatgggcctctcttatcaaacagatctccaacttgacatttcttaaacattccttccctagatttttattggtgagatatccatgtatttcataaaatcaacaagagaatccctgattgctcaggagaaaacaattctgaccggagaatgctgttacctgaaccccttacttcgaaggatcataagattcacaggtgagtacaagatggtgctgaactaagctctcacataaaagtaaaattactaaaggcaaacacttggtaaaataaactatggaagtatcaacattaaaagcaagggctgctttggggattttcctgatcctactgccacatcaaatttttgactctcgaaatggtacttcttaaattgtcttatgaatgatttcaactgattttccccccacatagcagttatctgagattcccctggacgtatgttttaatattggctggatattgctatataccttttagcagagtcaggcaaggggttggggtgggggagcatcaggggacgccaataaaataaatttagaaatagtcaaatttcctgacagacttcccatccagtaattttgttatgcagggaatttaacaaagagtgggaaatctcagccatcaggttcttgaaaataatgccttttcaaagttggaaaacaaatacttttattagtgttcatgatagggaataatgaaggcatattctacatccctccttctaggacttttatgaaaattcctgaggtgctagtgattaataattatagatatgggaataaatgtgtatgggtacaggtaagaatagagatcttacaaagttcctacacattaagtactctataaatgataactattacagtattctaatgagatcctacaaatacctcctgaccagatttttaagggagccatgataccatttaaaacaagagaactgacaactgagaaagtgagggtcagaatacagcatgctgtcaagccttttggtaatccttaatctttttttcctgttgtaggaaatgattgaatttcttcaagtaataagcaaataccacatcaaaatcaaatatgcaataacttgtctggttggagtggaaatgaaagaaatagtgcagtgggaaacctaagaaaatctaatttaaaagaagtaacccttaacattaaaatagtctcaggcatttgatgttatttgcagaataaaagtttttgcagattatgcaagtttgcaattggcttacagggtataccctgatcaatatgatgccactactatctagttcactcattccaaacaatggctccttccaaagatgtccagagtttgatcacttcccagaggggcaagataagagatcatcaaggggaaatgaggagagaagagaatatttatgatacagaacactgaactagacattttacagaaattatttcttttaatctacccaaaaccctgtaaggtattttattttattttttagacagagtcttgctctctccccaggctggagtgcagtggcacgacctcggctcactgcaacctccgtctgccaggttcaagcgattctcctgtctcagcctcctgagtaggtgggattataggtgcctgtccctaagactggataatttttgcatttttagtagagacgaggttccaccatcttggccaagctggtcttggactcctgacctcaggtgatccacctgcctcagcctcccaaagtgctgggattacagacatgagccactgtgcccggcccctgtaacgtatttcatagtcctagttgtacatatgaagaatcttgacaggaaatggggtaaagtaacttttccccaggagtaacgcatgcacacacacgtacataatttgattcagggaagattttatgactactgtccgatctatttcctgtatatataattaaagcaagttatttaaagcagagatttattgcaattaaattggaataccttttaaagtcagttatttcccttggcaaagataaattataccttttgtgacccacccacttggagcagggtccaaggaataaaaattttgactggcacttgtcatttatatagacctttatgcattggtagcacaagtctctgtttattgagggatgccagaagatcaccaccatccaggaaccagtcctctagattgtctgttgtggtatccaaaactcccacttgagacaccacattggagagaggcatggttcagaaagaccaccgttaaagtagaaatttgtcacgctggaggagcatcaaattcccatttataatcaatgacacattagtccgtttgggtctgtcataagctaatagagatctggaccttgggaggataagccagcgacattcaaataaggtgagttagagttcagcatcatgagattctgcttctaaggaagggatgctagagcagagagatagccaaaagataacatttaaactttggagaattagaggaaacagcattgaaaggcaaaggggattgctgggtttagtaaaaaaataaaaaaataaaaaaaaagcacttccttcacgctttccctcttttgttttttatgactctaggatccacccagttgctcaagtaaaaaacctgagagacaccttacgccatctgggaacttgttagaaattcttaaacctcattctatacctgctaaatcagaaaatgtagggattaagtctgattatttgtgttttcgcaagtcatccaggtgattctgatgcatggaaagtttgagaaccactggtttaggttattaaaagttcttgtctccctatatcttgttttgcaatatcattgcattcaccccagccccacaaagctaccatctattgaccgttttgtagctattgagctttttgaagcaaaaatatgagcaagtcaattctctgcttaaaacctttcaatagatttctagtgtccttaacatagcctacagagcccttcacaatctgaggtcctcacatgtctccagcctcatcccgagccactcccttgtgaggccctctcccatcatgctaaacggcttcacatggcctccaaaggaaagtgtgacaccttgcctcagtacctgcacatgtgctgctccttcagcctagaatattctattgctaccccttcactttacaagctggccaaaccctactcatcttcagaatgctgtttagacattacctgtttaccaatcccatcaactagttgcctcgtcttctaggcctccactgagccttgcacctacatctgttataggcacttctcatattactataattacttaaatctgttactcctattaatttatgatcgcttggagaacagaagttgtatctttttcattccatgtcaacagcatacttcaaagtacctggtacataggttgccaaaaaatgatttttgagagttgatatggtttggctttgtgtctctacccaaatctcatcttgaattgtactcccataattcccacatgttgtgagagggacctggtaggagataacttgaatcctgggggtggttcccccatactgttctcatggtagtgaataagtctcaaaatatctgatggttttatcaggggtttctgcttttgcgtcttcctcattttctctctttgcccactgccatctatgtatgatatgacttgctcctccttgccttctgccatgattgtgaggcttccccagccacatggaactgtgagttcttcattaaacctctttgctttgtaaatcgcccaacctcaggtatgtctttattagggtgaatgaaaagcaaagataaactttgttaaatcatggatttgcctaaaactagtttcataaaagctgattcttaagtattcatttgccttctgtttaattaactttattaccactttcagcttagtcctaggaaattaaagtgcataaatgaggtaatttctaagagaaagccagagaagtctgttctgacttttcctgtaggaggggtgaaggaatgcatctattaatcttgagaagggtaacttactctgagtatatgtgaatttttttcacaagaaagggtactacttacaataaagactctttaaatggaaatgttttctttggaaaaaattagagtaaaataagggagtaatcaaaatatattagaaaaacttattttgaagagcttaaccgtcttttttctagccccaaagctaccaaaatacatactacgcaattgacattggaaaatgacaactgtttccactagccattctaatgaacctgaaatggcatgaattttctcttgcagtttatgtaattattccacaatctactacaaatagtattttccaagaaatatcatcagctccacattgcaaaaaaggccagtgaattcatttttaagaaaataaggctttatgctgtaaaagatgaaaaaacgtgagattctaatacaattctggttaaattgatatttaaccctttctgcattgcaatttgacagtgtatttcaataaccttacaaataatggtctttttttaaccccaaattccactgcaaataatccattctaatgaaacaatcagaaatgtagattaatttttgtggactaaaattattttttaagttagatatctctaatttttttaaaaaaatgaggccattataagttgcaacctcagaaaatggtattaagaatttttcatggagaatattcatgatatgtgaaaagttaaaacactatgaatccgatcctttcctgatccgggagccaagatggccgaataggaacagctccagtctacagctctcagcgtgagtgacgcagaagatgggtgatttctgcatttccatctgaggtacctggttcatctcactagggagtgccagacagtgggcgcaggacagtgggtgcagcgcaccaagcgcgagccaaagtagggcgaggcattgcttcactcgggaagtgcaaggggtcagggagttccctttcctagtcaaagaaaggggtgaaagacggcacctggaaaatcgggtcactcccaccctaatactgcgcttttccgacaacaggcttaaaaaacagcgcaccaggagattatatccctcacatggctcggagggtcctacgcccatggagtctccctgattgctagcacagcagtctgagatcaaactgcaaggtggcagcaaggctgggggaggggcgcccgccattgcccaggcttgcttaggtaaacaaagcagccgggaagctcgaactgggtggagcccaccacagctcacagaggcctgcctgcctctgtaggctccacctctgggggcagggcacagacaaacaaaaagacagcggtaacctctgcagacttaaatgtccctgtctgacagctttgaaaagagcagtggttctcccagcacgcagctggagatctgagaatgggcagactgcctcctcaagtgggtccctgacccctgacccccgagcagcctaactgggaggcacccgccagtaggggcagactgacacctcacacggccgggtactcctctgagacaaaacttccagaggaatgatcagacagcagcattcgcagtttacgaaaatccgctgttctgcagccactgctgctggtacccaggcaaacagggtctggagtggacctctagcaaactccaacagacccgcagctgagggtcctgtctgttagaaggaaaactaacaaacagaaaggacatccacaccaaaaacccatctgtacatcaccatcatcaaagaccaaaggtagataaaacgacaaagatggggaaaaaacagaacagaaaaactggaaattctaaaaagcagagcacctctcctcctccaaaggaacacagctcctcaccagcaacagaacaaagctggatggagaatgactttgacgagttgagagaagaaggcttcagacgatcaaactactctgagctacaggaggaaattcaaatcaaaggcaaagaagttgaaaactttgaaaaaaatgtagacgaatatataactagaataaccaatacagagaagtgcttaaaggagctgatggagctgcaagccaaggctcgagaactacgtgaagaatgcagaagcctcaggagccgacgcaatcaactggaagaaagggtatcagcaatggaaaatgaaatgaatgaaatgaagtgagaaggaaaatttagagaaaaaagaataaaaagaaatgaacaaagcctccaagaaatatgggactatgtgaaaagaccaaatctacctctgattggtgtacctgaaagtgatggggagaatggaaccaagttggaaaacactctgcaggatattatccaggagaacttccccaatctagcaaggcaggccaacattcaaattcaggaaatacagagaatgccacaaacatactcctcgagaagagcaactccaagacacataattgtcagattcaccaaagttgaaatgaagaaaaaaatgttaagggcagccagagagaatggtcgggtaacccacaaagggaagcccatcagactaacagcggatctcttggcagaaactctgcaagccagaagagagttgggcggggcggggggggccaatattcaacattcttaaagaaaagaattttcaacccagaatttcatatccagccaaactaagcttcataagtgaaggagaaataaaatcctttacagacaagcaaatgctgagagattttgtcaccaccaggcctgctctaaaagagctcctgtaggaagcactaaacatggaaaggaacaaccagtaccagccactgcaaaatcatgccaaattgtaaagaccatcgaggctaggaagaaactgcatcaactaacgagcaaaataaccagctaacatcataatgacaggatcaaattcacacataacaatattaactttaaatgtaaatggactaaatgctccaattaaaagacacagactggcaaattggatagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactgtaaaccaacaaagatcaaaagagacaaaaaaggccattacataatggtaaagggatcaattcaacaagaagagctaactatcctaaatatatatgcacccaatacaggaccacccagattcataaagcaagtcctgagtgacctacaaggagacttagactcccacacaataataatgggagactttaacaccccactgtcaacattagacagatcaacgagacagaaagttaacaaggatacccaggaattgaactcagctctgcaccaagcagacctaatagacatctacagaactctccaccccaaatcaacagaatatacatttttttcagccccacaccacacctattccaaaattgaccacatagttggaagtaaagctctcctcagcaaatgtaaaagatcagaaattataacaaactgtctctcagaccacagtgcaatcaaactagaactcaggattaagaaactcactaaaaaccactcaactacatggaaactgaacaacctgctcctgaatgactactgggtacataacgaaatgaaggcagaaataaagatgttctttgaaaccaacgagaacaaagacacaacataccagaatctctgggacacactcaaagtagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaacagagacacaaaaaacccttcaaaaaattaatgaatccaggagctgattttttgaaaggatcaacaaaattgatagaccgctagcaagactaataaagaagaaaagagaagaatcaaatagatgcaataaaaaatgataaaggggatatcaccaccgatcccacagaaatacaaactatcatcagagaatactacaaacacctctatgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtatcattccttctgaaactattccaatcaatagaaaaagagggaatcctccctaactcattttatgaggccagcatcatcctgataccaaagcctggcacagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcagtatacacaaatcaataaatgtaatctagcatataaacagaaccaaagacaaaaaccacatgattatctcaatagatgcagaaaaggcctttgacaaaattcaacaaccttcatgctaaaaactctcaataaattaggtattgatgggacgtatctcaaaataataagagctatctatgacaaacccacagccaatatcatactgaatgggcaaaaactggaagcattccctttgaaaactggcacaagacagggattccctgtctactactcctattcgacatagtgttggaagttctggccagggcaattaggcaggagaaggaaataaagggtattcaattaggaaaagaggaagtcaaattgtccctgtttgcagatgacatgattgtatatctcaaaaaccccattgtgtcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggacgtgaaggacctcttcaaggagaactacaaaccgctgctcaaggaaataaaagaggatacaaacaaatggaagaacattccatgctcatgggtaggaagaatcaatatcgtgaaaatggccatactgcccaaggtaatttatagattcaatgccatctccatcaagctaccaatgactttcttcacagaattggaaaaaactactttaaagttcatatggaaccaaaaaagagcccacatcaccaattcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggaatccctatttaataaatggtgctgggaaaactggctagccatatgtagaaagctgaaactggatcccttccttacaccttatacgaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctataaaatgggagaaaattttcacaacctactcatctgacaaagggctaatatccagaatctacaatgaactcaaacaaatttacaagaaaaaaacaaccccatcaaaaagtaggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtgcagaaataggaacacttttacactgttggtgggactgtaaactagttcaaccattgtggaagtcagtgtggcaattcctcagggatctagtactagaaataccatttgatccagccatcccattactgggtatatacccaaaggactataaatcatgctgctataaagacacatgcacatgtatgtttattgcggcactattcacaatagcaaagacttggaaccaacacaaatgtccaacagtgatccactggataacgaaaatgtggcacatatacaccatggaatactatgcagccataaaaaatgagttcatgtcctttgtagggacatggatgaaattggaaatcatcattctcagtaaactgtcgcaagaacaaaaaaccaaacaccgtatattttcactcataggtgggaattgaacaatgagaacacatggacacaggaaggggaacatcacactctggggactgttgtggggtgggtggagcggggagggatagcattaggagatatacctaatgctaaatgacgagttaatgggtgcggcacaccagcatgtcacatgtatacatatgtaactaacctgcacattgtgcacatgtaccctaaaacttaaagtataataataataaaataaaatttaaaaaaacactatgaatccataattgtttttaaataaaaagaatgcaacattatataagtgtatatgtgtatttgtgtgttatccatagcaaagagactgaagggaaacacactaaaaattagctgttgtcacttctgaattgtaggataatgggcaaattgggcaaataatttttggctttctaatgttccataattttaattttttatcatgaatatgtttacttttagaaatcagaaaaagaactaaagataatttttttaaagagtgagggcagaataaaggctatccagaacgatggccaagttctctaacagtcttcagtgtggatagaagagcaaaaacttcaacttgcttctctaattcttttgtctcctctcgtctgtgtggcatggatttgaaggataggcttctgcttcaccccacagatccaaattaagttttaaatgagacaatgacaagaatagtgacatcaaagagaaaacattcaaattcaaccatctcctcctttagcaaatgctaatggtgttgactttgacggagagtattaaattcctttgattcacaaatccaacaatacatttttccccccaaccttctcattataagaaagctgcctgtcctcccaggctttaagcataaaacatcatagctaaacttctctatccacttctaaaccattgtatagtttctcaagttatatttatataatgtgcaaagggaggaaaggaactggctaaactaacaaattttacctgtactttataaaaacaaatgtaatcaaattagtaacatgtattaagactcctctctctcattttttccctcttcatttcttttactttataccatttcctttgctactacattacattgtgtagtaacagcaacacagatttatgttctcaagagagttaaacacccacctttctttttcagtggcaatgactaagtaaggaagttacattttccaaaaaaaatgtgaagttcagttcagttctgctcacaaatatacttgagtaaatatttttgtaaatataaattattaaacagtaactttttaatactgaaaagtaatgaatagacagcattagaatttgatgagggtttttggtttgtttaccatatagaaggaaaaccaaattaactttcccttcctgaatagttgctttgagttaattaaaaaactgatccaaatatgcaaacattagactattagcactaaaatagcttgtcatccagagctcttcattatagtcttttcatttggggtcacacagttgatccattattacttctaataaaaatttaattaaataccagccaagtcttctgccatttaggtccggtccgaggattaggtagcactggacagactaaaaagtgccatggtaaacagcgaattcatgtaacgctaattaatttccataaatcaagtgtggtctaagtgaagcatgaatattttaaatgcagtttcaaaggtcatggcgttttatggttttaagaattgataccctgggacgagcttaatgtcagcctttttgagaactagaaaatcctcgattttgaaagtcatttaaatgtactttatcagaaaaagactttatttgattcaattagtctatttctgtttgcattcagtatttatagttaaaatacagctggggggccggtcatgttcattcaaccttcaatgaaatagtcattgagcacctactagatgctaggtacagattaaggtgtttagaatctatgagtgaaccaaatagaaatgtgccctcattcagtttatagtctgatagaaaaagccagacactaaacaaaataaattataatgttagaagataagtagtacagagaaaaatagggaaaggaaatagggagtttgtggcagcagatatgtaattttaaatggagaggagaagctgtataccatgagaattgttgagttggcagtgaattcatagcaggacagagcaatcaagacagggatgatcccagggaaacagatgcccagggaaccaggccagctccatgtgctgaccgagaagttcaatctacccaggtagtctaaagataagtgacagtgcccaggcacccaactttctttctgagccatgagtctagatcataaaagaaaaatgtcaagagcaaggcaggacatgggcctataagcagatggagataatttctagaattcagcaacaggaaccgtagttgaagctcaggtacacaggttaagaggaaagagccaggaagaatcttcagggaacaaaatggaacccctgtttctggaccacttaagcagccaaggcactagattagagactaagatgtttgctgcttcctactagggatcaggattgggcttgtggctgggattcaaggatgcaggggaggaaggatgctgaagctggtaccatgactggcctagaaggcgtagccagggagcaacctttgcttgggtctcaagaaattgtgatgaggttacttttggttcctctgctcagtgcagggactgaatctattcccctttgattgtcatccttggtgagccagaatattacagatctgaccaagactcctaccctagaactccctagattaccctaattatcaagaggaaagttattgagtcatatgagactagtgattcttttctgtgggtcctccttagctctagtgttgagaggctggactccaataaaggactgagcagaagactgctttctgtagcactttgcaggttagacaatgcaaattcatgacactacagtgaacttaattgctgtaaaacagtgtttcttaccctcagcactctcgacattctctgccagataattctttttttgtgtagaagtagaatactgacttgtgtgcattgtattaatacaatgtttagtagtacccctggcctctatccaacaaatgccaatagcactcactcctctagtagtgacaatcaaaaatgtctccaaacattacaaaagttccctggggcagggtcaccctcagctgacaactacttttgtaaaggtttttttaagtatatttcaaagacttttaagaagttatacaatatcttgcataacaaaaatattcatataacaaaactaggcactaactgatgactcaacagttagtaaagtgtagtttcaaagctttctataataatttttaaaaagtagtgtgtgttttggaagcaacttacttatttttattttctgagacagggtcttactctgtcacccaggctggagtgcagtaacatgaccacagctcactgcagccttgacctcccaggctcaagcaatcctcccacctcagtctcctgagtagccgggagcacaggcacacaccaccacacccagctaattttaaattattattatttgcagagacagggtctccctatgttgccgaggttggtctcgaacttaagggatcctccagcctcagccttccagagtgttgatattataggtgtgagcagaaactatttaagttattacattagaacataatgaaattgtttaggaaatgcatcaagcagagggcaacagtgccagatctcagtatctgtaaatcaccaacagggctgggagctgcccatgggggcttgatgctgatcttgtggtaggaatgggagtagattcagatcatcagcttcagctttagaaacttacaaacatggaatcacaaaagccgaatttgaagccttctaaaaatccaggcctcaatattcctatatttcgatatctcttggtagctacatttttttctccacatttagtttgtatccagggcatattttctagacttacttgcatccacaggttccattccactttaaagttaccatagcctctggcaaacttttatgttttcctctgtattaagcagcatttggcattataccgcctagagggaccgagaagatatttagaggctaggtggcaagagagaaggctcatatttgtgagataaagcactggggaattgtcctgtcaaaggagtaaagaggacattcttgagataaaatcctgttaagaagcagagtaattttatgctttgaggaagtaaaaatgtatttgtttgttcttttgtttataaaaatatttggtgggctttctagttgattactcatcatctttattaagtaattatccttcatcttcacttatcatgagtaattacaatgacaaatacagggtatttttttctaaaccaccagcttatcgcattgtaaaaggtgctttattaatacaaaggatgaataactgagtcaaatatttgtttcaggttgttacaattgtaggtttcttatatctttcctgcatttaaaaaataattttataatcaatttataaccacttcccttagttacatctacttctctcagttataagagcaatatcaataaagggctcacaattgacaaagtgtttttacaactgttttttatgatttgaataatcaccctgtgatacaaggcatacttataattcattttaacagataaagtgactaggttcagattaattgactttaataaaatcttttcttatgatttcaaccatctgatcaagacaagcaggctattgtcagcctttggtgtttgtgcagtatcgataggagaaagactacagcattgctctgtaaacacctaaaatttactatccaaggaactgatgtattcaattttgccagaaacttatttttgaagcacaatatatagggcatatggatcaattgcaccgaatgtgtttgtcatactagaaaaaagtcagattcattgctaaagtgatgagaaaagtgccttattcaaatgatgacatatcatagatattcaatcatcttctttttggaaaattgactacaaaattgaagaattcgtattctgttgtggcaagtgaaatacatttcatgagggacatgttataaagtccttgcctcttctcagtgctgtgtgcatgtgtgtgtgctcccaagcataagctaagatatctttatggtctgatgcttatccatatgtatgttaataataaataagcttagacaattatgattaagaatatagcctctggagccttactattctgtttgtaacccaagctcctctactcactagctgtatgaccttggtcaagttaattgacttctctggatctcaatttcctcacctgtaaaatgtagggataatagtgtctacctcaaagtcatggtgagcattaggtgaactaatattgcaaagcacttagaacaatactttgtatgtactaagcacagcatattagctattgttattattacctggtatccatggcagtcatagttaaacatctcatcaggtcagtacacctttataaggaaatgggatgaacatggtaacctcagataaattatcttcataggaaacttccagtttgaataaagcatgttaatgagaaagcattttaccacttttcctaaagaaactgtggtttcctgaaggaatggtcttcaatagttgaattgaggtaccttggcaaaaatggaattagatagagattttctactggggatcctgatgtggaaaagaaaaagcaaaagtaaactgtatgtgtttctttaatcttgtgttccatttccaatggaagttggtggttgaatcagaatgtggttggggaaacagtgttaagaattccttaggtattcctcttacagtgttgaaatggcactggtaaacccctgccatttgcttgtacttttctgtgtgggataagatttttttatcattttttctaccaaaacagaggccagaagctaatgggagggcacgttttctcattttgtggacatcacggtagaaaagctaccacaaagagatgcacaaagctggttagattttgaaaacgagaaaatgttcaagtatcctcaatatcatacaacatgctactactttcactatctttcacgacatcgttttaccatagagaaacaaaagaacagtcctctttttaacagtttatttttgttgttattttgtttttgttttttgagacagagtctcgctctgttgcccaggctggagtgcagtggcacaatctcagctcactgcaacctccgcctcccacgttcaagcgattctcctgcctcagcctcctgagtagctgggattacaggcacccagcaccaccggctaatttttgtatttttagtaaggacagggttttatcatgctggccaggctggtctcaaactcctggccttaagtgatccacccacctctgcctcccaaagtgctgggattacggggacaagccactctgcccacaggtttttttgtttggtttggtttgttgctgttgtttgagaaggagttttactcttgttgcccaggctggagtgcaatggcacaatctctgctcactgcaacctctgcctcccaggttcaagtgattctcctgtctcagcctcctgagtagctgggattacaggcatgcatcaccatacctggctaattttacatttttagtagagacaggatttcaccctattggtcaggctggtcttgaactcctgagctcaggtgatccgcctgcctcggcctcccaaagtgctgagattacagcatgagccactgtgcctggccaacaatttttgataagagattgagaacgaatgttaaggaaagtagggaggggtggtaaaagctgcggttcagactaagcaactgcccacagagtagcttttcaacatagatgcagagtactgttggcaatttaatccagataaattgtttttatgtctttttcactattcttttcttttttaaagttccatgtgttagtttccccacatgaaaatgtatagaagtttttatgtgcccacgtgttaatactgaaactgacaaccattgtaatttctcagaatcagaaatagggacatttctaagatatgcatgtttcaataaaactacccatcaatacttcccaagttcatcatgacttgagtttcttgtgcttcacaaacatctccaataaaaagtatttgttgtgtatgacatagatctccatactctaaggttttttttattctcactgcattagaatagagagtgctttgatttgtgaattatgatttacagttttccaattcatgagacacttataaagtcccagtttttaatgatcacttattttctagttgcctagcactatgcccgactttgtgaattttataaaaaggagatatgatccctgcaacatacatgctaaatggctttttgtcaactatgttctctgaaatcagggatgcaaagcaccaacatgaattagaaaatatggacaagtttctatgctcttttatcctcttctgttaatctctaaagtttcttcagcaattcattcattgatcccacaattatctgttaaatgtttactatgtgccaagtttgatgctaggtgctgggaatacaatgatgagcaaaaacaaatgtgttccttgctgtaataaagcttccatattcaacaattctaatgtgacagatggaaattattgaataatctatgcaagtgtaaagttcctactgaaacaagaaatatgagaataatggtaccatactagtctaaaataggagatttttccaacatccgatgtgatctgtgattatttctccctatttactcttaaatggggcaagacctatgcatgctctattcatcagcagaagtgtgacttgctcttggccaacttttcagagctacagcttgaaagcagacgtacacagccccaagtccagtccctagttagcaggcttcctactagagctcctcagctccaaggaactagcatctgctgtcctcactgtgtggctcattggtactctatagagcgtgcacaaagctgctatagccagcagcagccacgctctccagaacacgtggatctagtcctcttggaatgcgaaatgcccatgcctgtgcccctgccacctcctgttgagttcttgtccaggagtctctctgtaaatacatttaggaaaaaaaaaggtaagagaggagagtcttcagccaattcagagcgaactcatccagtggggagacagaagccttgttttctggggagtctaaatcctggatctcagagtcaggggcctgatagtatgaaagaaagaaagcctttccctagattttctcctgccgtctctgtagtctctgtcttctgaggagaagcttgagttttccatgaggtaaaagtgtgtgtgtgtgtgcgtgcatgtgtgcatgcgcaagtgtgtgtatgtgtgtgagaaaaagagagagattaaacatactccatatgaaggttatcaacagtggacccctctcactcatcctcccttcagtttggtgtcatttggccaactttccatcttttttcactgtcgtcatgtatgattttagtggacaatgagagatgatccatcagaggctgtcagcaaagtgcctttttgactggagaattacacatttataatttagtatgcaacatttggccttcagttttgaggctctacccaaggtctcagactttccgggcctaaaaggaacatggtccttcctttgctcaccccaccaacctctgctaattgttactctgttgcatgcatctaggcttcctaatgaaggtctgctgtgtggacagcactgagcagtctggttctgtacttttcccagttctgaagggatcctggaatgaggcctgttattgtttgtcagtagaccaattactggtggctttgaagatctccttcatgcacgtttcctggttctgtcactgtttctactacattcttggtggagtcaagtgctggagtcctgtgctgagtccatagcaggaatagggtcacagaatttcactccatgtcctaaactactagggatcaaagatcctaacttgtccaaagacatcctatctgagatcagatggggtccaggtaaaaccctgagaaaaaagtgagagactttaacaccttcatcatcctctttctttatcctttgtttagcccagtgtgcatcagttatgttcttttaggtcacaaagagctcaggtttccttagacaatccatgttactgggacctgatcatggccatcaccagcagacaccaattttttttgtccttccaagcctcttctcaactaatttgacccttccttggccattgctaatgcagttaccctatgctgtggtgccaagctggatgtgaaacttctctaagatgtttgtggggttcccaatctacaccccagcaggaacacgatgccctttgtccacatttacaaaaaacccttctggagatttgtatttcccagcccctgaggcttgacaccagcctgaggcggggagcctgtaagtacctctttacttctgtaatcagaacaggcagggcttcagctcctcctgtgacacccacatctgcttcctcacctgctctgcagctgatttcagaaactttgtaagactgtctcgccctccaggttgtagctcttgatcttccaaaccaagcatattcagaattctgaacacagccacagcaatcacaacaaggacatagctctggcaaataaaaagtgctttacttctggacttttgtgtctgttgtaaattggaaaatccattcagaaacataattggctttggcttctctgaagtaagaaacaacacagatggagcagagccttaagataaatagaaccatctgaggggtgtggggttacagaaatgaaaaatatctattaaaaaatatgatctcacctgaagaattttagactccaagccaagatacagagacatttttaaaacatcttcaaatcataccttgcaatactggagaccaaatggtgtttcatctgactctaagggcaaaagtagctgtttttagcttctgaggcttgtaaaaatacacacaaggagcgtagggtgaagtaagagagagatggcttgagttcctttggaaaagccctgtatgatctgacatggtctgtgagttaccagtgcaggttccaccgcgctttgttggtgtggcctgcatggggcaggtgggcttcccaggctgatgcggtacttcctgaagctggatcaaatgcaccagaatgaagtggttggacagcggatgctcctgaagccagcagaagaaacagacacaatccacagaaggcagagagaagaagagaagctactttcagccttggcatacaggacaatggtgtggagagctggccaccatacaatcgctgtgaccacagagctggcactgacccaaggaacctagaaatcctctgccaaagaaagaataaaacctgccctaattggaaacacttctgacaaaatgccaaagggagatcctgccacttttcctttttcagatcgtaaatcaccctagtttcctggaaaagttatgtctggacagacttattgccccttgaaagacccagcaacctggtctttgaaaatcttgctggaagatgtagaaaatctccaaccattcagacttccagtacctgggggtgaaaactgcctcggatgatcaatgaatgcctgctctcagaggtcagacccaatgagtatgagccagcagaagcttaagagctagttctcattatgataaagcacattctggcaaggccacaaaaagaaagatgatggcaatcagcacagatacaaatgaaaaccagacgaaggtttcagccaaactagtcttcacttctgctataatggattaatttttgggtgctgaagtcagcacaatttgcagattcagaacactgaatacgggagtcaaaattgggtagacatttagttgaaactatagcagactcttgacatttacaagggttaatgctgcctctcgcacttgtcaacttctaccttcaattgcatataatacatcttcatctcttcaacccacttatagctctacacagcctttctcagtgcatagatgtaatatacaggccttgaaataactcacagcaaagctttctgtaaggaaacctctgcatgttcaagcttgttggggctaatcctctggaatttaccagagaacaaataaaatccaggaagtatagcctactcacagggttttcagaccaacagcaaaaccagaataatgcacccttccccaccaaaggatgatcatgtccctggaaactgaatgttaccttacatggcaaaagggaatgcaggtgtggttgaagttgtgatagggagactatcctggattatccagatataatcacaagggtccttataagagacaggcaggaggctcagagtcagaggagatacaacagtgaaggcagaagttggaatgatgtgaagtgctggaaagaggccataagataaggaatgaaggcaacttctagaacacatggaaaaggaaagatgtggattataccctgagcacttagaaggaacacagccctgccaatgctttgagtttagcttagtggaacctattgtaggcttctgaattccagaatacagaagtctgaaggggatacatttgtgttgtaagcccctcggtttgtggtaatttgttatagcagcaataggaggctattggtcaacaacatttgtttttaacacttttcctttattctcattttctgtttccaacatcaaatgaaactccaattcaagcaaagtttctagaataatttttttaaaagacaattccataagatcctcctttactctcacctgccatgttgtaaataactcctcccaagatgatttacatttccaagtagaatcagggagaaggtatttcgtatagaaggagagagaactgatgttgattaattacgtagacaccatagcaagtattttgcacgtagattattctcttttccccaaactaccccctactccattttgcagcaaaggtaaccaagattcaagaaagataaataacttatactctgaatgagtcaccactgatgtgtctatatgactccaaaattcaaattattttcgttagactgtgctttttctaaactaccgatacaaaaccataaagtcctaacagtagaatgtctacatcaatttggaagaaatggtgatttgggaagcaggtaccactcctggaaagatactccggggagtacttagaatcattttgataggtcatcatggactctcaccgctgttttctcttaggagaaaaatgcaattgacagagtatgttaccattcctaatgattttaaatcttcttataggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacggtgagtgtgcaagtcttgtctctcctaagtccagtttttgataggatgtgtgtctccctgccctgtctccattctttcattgtcacttatagcgactcttaaatttatgtatggcatatttctctacattatgctattgatatactagcccccccacacacacacttctaccccactttcaatctcctgatctgccagaggatattagttctggaatgttttgataatcacctaattacatcctcccatttacagatgtgaaagcagggtcccacagtatagctaagatcatacaaccagagcagggacccagactcctggtactgtgtctgagattttcttacctcccacaacagtactctttgtcaaggttttcgttggtttcggaacagcacaccttctcacacctgcctagaaatttgcaagcatgggccttatatgaatgactgctccaacaacatgcagacccaggatacacagctttcctttgctctggcacttttctccatgactttgctaggagacagggatgatcctagaaaaacctcaacaccccagagtatgtttctcattgtcccccagatcgcacagccattgactgccccactggggtataattttctctggttttctttttgttctagtaacagaaaaaccaaagtatgtcccacatcttaaagaacaatggtgtctctcttattttccaactttttaactgtattcattttggaaataacttcatttcactcttgtctggcttatgcattcttaggacccagaatatagacatgcagagatcagctcaaaggctccacgggctgatacgatattgctggtggacatcaggtgcatttaccagtggcagagcaactgttggcccaaaacaccccctttccttacttcaacttattttatattcagaatatgactagtctggtaattctcaatggaaagtgtgggaatggaaaagacagaaggaagcctcctttcaaactgtccattcttcccaaacatctgagtatgccctcaacccaccccccagggagatgctacccttcctgtcactgagtgtaattgcaggaggcatgttctgcctctgcgggaagaaaacgggtctgtgccttcacccctagggtggaaaaaaggcaaaaactcatatgggtttcttataccccaaatgattctttaatttgtcacataaaaactgcatgttctgaatctaataattaatacacagtcattctttgtgactatgggtctgatctatttatttaaaacaaccaggagcagatagtgcctttgtgtcccatttacaggatcacatcgatagggttattttgtcaaccaccaactatgtgacatgagtatgtgaaaaaaaggacttcagctgtccccacattaaagaaacaaggatgcaaataacacagaagcctcaatttacaaaacagattatagctcagttaaatgtctttgctttatcaaaaacaaaaccaaaccaaaaaacctctatgcaggtattttttttaaacaaataaagccctctgaagtatccaacatattttcaaattttcagaatgttgatttttcctaattatctagaacctaaacaatgtattcttgtgccttttcctgtattttttatcagactcaagtcattgctgtgtgaaattaatttttatagtaccattataaaaattattctgttacttataataaactactgtctcaacaaatgagatacgaagttctttgggcaagaaagaagtaaatatcatcagctcacacagaataaatgtgactataacatgttctcaaggattcagatgttatccaattcaaatcatgcctcacagactatagtcagataaaccctgatataagattccaattgcataaatcttctgagccgctattacatgtcaaatgctttcagaaattactcaacaaggatttcctaagtactggttaatactatgaagaataccaactaaccataggctcatgcttttaatagtttttaatctttcttataggaaagatttatgacagatataattggaaaacataatagcatgaacaactgaatatatgcagcataggttttaagtaacatttaccagagtctgaaaatagtgtaataatatgctgtaatttatgtaactgtgatgtaaccagttttatagggaatctgttatatagaagagattcctatcttctggtattctcaccagtgttgaggtatcattctagaatattaagaatttctattgtaatactgtaaaatgcgtctattttaacttatatgtgctcaggccatatacacatactatataagtatcagcatattattttttagaattgctaagctcacatagcacatttgttaagaaatgatagaccaatggtgccctctagtggtgttttgtaactactaccaaaggttagctaaaaaagtgtacttacatgaaaaaggcatggcttcctaactctaaaccaccagggacacatttgctaactgaacctgtaaaacgtcagagtcttacccagcacctcacaacaaactaataacagccgcctacatctcaggtgtcataacgtgtatcatcttttacttagctcaggtcttcttgaccttttgtatcttgtggaacacacagaaaattttaatattttaagaaacagtggagtaaatgaatgaataaagctgatcacagctgtcctgaggaatgtatgagtcaatttactagcacagctgaaacctatttatgtgatgcagttgttgggaggttctaattcagcctatcaactaactcatcagtcaacactttgttggtattaatcacctgaaggtgtgacaaagcaactaggaacttttggggacacaaaaaataaaatgtacggtcacttacagtcactctcctacctggtcttctccaccaaaagcttcattcccatagaaggtttatttggtatctcagactctcatatggatttcttataccccaaatgatatttaaacttgtcacataaaaactgcatgttctgaatctaatcgttaatgcgttctttgtgtcactaataacttctgttgacatgtccactagattacaaaagactgaagaatgtacatctgttcattgttcttgctgcactgatttcctacctaaataatttattaaatatcttaatggagttgttcaaggaatactagttagtgtggttgctttgacacaagcccctgcttgtgtatgctggtgtatgtacctgcttgcttgcatgtgtactcatagcacaaggcagctgcctggtcactccctggcctctgtcctattccagatgtatattacaagcacaatcaagacgaagagcagtcgactggccaagccggtgctgtgcctcggaactctctgcacagccttcctgacaggcctca

SEQ ID NO: 10 - DNA, 62895 bp, Homo sapiens
gctggtggggagacagcatgccactggtaagtagctgagaaatattttgtaaaatagatatccagactaagatttttaaagcaagcgacatgttttgagggaatagaataatgcaaaattgtgtaggaatctctgattctaatcagcagcattgggaaatggattaattaaattctaaatattccctggtcatttttctagtttaaagcttgtttcttaaatgatggagttgctaggaggcaatatagaaactttccccttgtgattcttgtaaaatatttcctaaaataagatttaatgaagatgttactaaattggagaattgctttcagaattgtacctcagctttacgatatttgtatttgacgtgatgaaatgggttatgattcaagatgttctcaaacctggtttattttctcagtgctgggagagcataagaaaaatattactttgcaatgcagaaaaggatacgatgcctcatttttttaaattaagaaagtcgtgtgacgggatgtctgtactagagagaaaatgaggaagagggcagtttgtaataatgttcagattgattgcttcatgtgagatatgaaagtgtattcaatgagaaacattaaaatttgactttaggatgaaaaaatcatgaaaaagtaataatgaatattatgatcgtgctttcattggaaaaaattaatttgtatttttggacagcgatttatacagtaaagacaagagtgttctcggtgcttctttttttgaaaagggatgtgagatggatagcagagattcttatcaacgaagctttaatgtttgtttctgaaacattcctgaaaacagagcttttgtagctctgtttctgcaagaaaaacgaaaaaaaaaagtgaagtggtggtttattcctttgaaattcaaactggcccttgaacgtgaggaaaagaaaaatgatagataaatagatttcgtttttgagttagatgacaaagcagcagcaatcaaggaggaaaaataagaatgaaaaagcttaaaagaaagtcctcaagatgggccattttcccaagttgaacatgtctgctggtagcatgttttgcagagggaaagggagagaacatactggaggcaaagggagggggtgttgaacagagcactgcggcaaagagagtgactgacgcatccagggacatgtgaccattctctggtgtagcgaagaaaatttgccaggactccatcttgtataagacattctatacatactgacatgcaaataatgctataatctttctgtagtacataatgagctcgttttgcgtgatcctccactggtgtatattggtattttgtctttgcttctacgccttcctctctgtgcttccagtgcttttatacacttactaaaatattaaaaatgatgttttcccctttattataaaaatatcatagtcattgtagtaaattttgaataatgtaaagatgattataaaaattacccataatcccgtaacttagagataattactattaatcttattactgtcagtctcttttctctgaatatatgcaaataaatgcatagaaatatatattttatacaaaatgaagatcacatgtacatacaatttttagcctgtttgatccattaaatatatattgggagcaattccccatattttaaaatattccacaagaatgtggtgttttgtggatgtataattttctatcatatagatgtcccactaaatgtccaattattgaatgtttatatgtgcattatttttgctgttataaataactgaaggaatatctttccatataaatatctgtgtgcttttctggttttttctccctaggaaaaattcgtagacatggaattcctggatcaaatggtatgaaacaatttaaggtttcttccccccaacacctatcacctaatttatttattatatgtggtataaacattattttccagccattgttttcctattaatttttaccatttatggtggtgattttttgatattttacagttttacatgttagatttccatatctgaccattttaagtgttgtgatttttttctttcctttgattagtgtattcacctgtatttttttctagttatttaattgcttcattttttacaattaactccttaatccacctagaattcattttgatatatggtatacagtaggatttaattttttttccccctaataggtcaccgattgtttcagcatcacttattgaataatccaacgcaacaactgttcttccattagatagggtgtagctttccacaggtcggccattttctctttacccaagatggttacattttgcaatggtactcctaccttcctgcagcttctgacagcatactagagcaccatgtttgtgcttgtgcgtttcaaaaatcctaggcacatgcagattagggcagtattttaaacaggattttttttttcattttaaatatgttaagtttgtcacattcttgttgcaaattaaaattaaggaatccaaatatatgaaaccacggtttcaggtgtgctattcctcttaggcgcacctgatatcccaattgtgtgttaaaaaaaaaaatacccccggggttaaagttcctccttcaacctcttttttttttttttttttactcttcagatactcaaagagttaaagttggctcgactcagttcttggaattttctagaatgatataagagggaaatacaagaaatgtatgaggagtagaagtaaataatgtttgccagcctgttgctggccgtagtctcatgtagggatttaaaggagctagggtgagtcctaacccatgccaccactgccactacctcttctagatagggacacaccccagtgagccacctcttttcactgcaggtgtaaggctcaagacataaggcaaggagttttttagtaggagatgggttaaatattgcccagagaaatctgacaattaaaatcacttgctacctattaccaaccctctcccgggcccccaacgaagctttctctctctattgacttctgcaccgggcctcttagctttactgattctgggggggaaaaaaaagggcggggggaggatggcgcgtgagtgggaggctgccttgcctgcggttattgcaaggggctcctttggctcacagcctcagtcccagtagtttcctgacttgccgcattagactgtgttttgtttatgaggaggctggtttccctggcaatggcagctcgccagtgcatgcgcatttgctccactgcagtagcagaatgcggctgtggggccaggggaggggtcctgagggccgcagtggctggagttatttggcagacatgacgtcagtttttctgagctaaactgccatcgttactgtatatggagcatttttttttttttaaataaagcttggaaggcttttagccactccttttctttcctcccaaattaactgctctctatatgctcaccagtgaccacgaaggctttctaaggtttgaggccaccgatgccctcagggccccgaggggaatcataatagtatgagaacaggaaacagactgcctggtttcagacctcggctgcttgctagttgcatgactgtgggacgggttacttaaatctcttcgtttcctcagatgtaaaatggggatgctaacagcatgtttagaacagtgtctggcacatagtaaccattatgtaagtgttgtctattattatttgtagatactaagggggacttgcctggaagcagacttgtgtccgcagtatacaaactcaccctttaatgcacacactgaccagataacacaaacacatttacccccacagcacctagactcttctcacagtacacacacttgccttccagtacacagacatatccaaaggcacaccgacaagcaccacagcaaaaagatgttccccagaacacatggacaccccaatccccgtatcattagactctcccagaggcacgtatgtactgcttaatgcagagactcacctgaggcacactgatgcaccccgcatgacacagacttgcccccccataaggactctactatgacacacagacaatcccaacatcacacactgttcccacatcacacgaacccattttaggaaacacacagcatacagacttaccccatagaacacggcttccccgacaagcacacatactctcaaggccagtagactcaccccacagcacacagactttctctagagtgtacagcttcttcccacagcaaacagactctccccagggcacacagacacccctgacatcacatactctcaccacagaccatagactcgtcctagagcacagggactcttgccaatgaaacagactttcccgagaatagactcatgagacagcttgaagacccgcatcatgacacaaagactctcccacaacagacagactcaccccattgtgtacagacaagcaccataggccacagaccatcacctcaggacacagacttgcccagcaccacacagacactctgcagagcacgtagagtcaccccgcaaagcacagactaaacccatactacagagactctccctatagctttcagacaagtttaccccaccacagagacatgcaacggtacatcttacaacatatatcactccttgatgcacacaattgtgccacagcacacaaacttgtcctacagtgcacaaattcatgtcacaaaagacacactcaccacacaatacaaatacttgctccagccggacgcggtggctcacgcctgttatcccagcactttgggaggcctaggcaggtggatcacctgacgttgggagttcgagaccagtctcaccaacatggagaaaccccgtctccactaaaaatacaaaattagccgggcatggtggtgcatgcctgtaatctcagctgctccggaggctgaggcaggagaatcgcttgaacccaagaggcggaggttgcagtgagccaagattgtgccactgcactccagcctgggcaacaagggcaaaactttgcctcaaaaaaaataaaaaaataaaaaaaaaaacaacccagcaacaaaaacaaacaaaaaaaaacaattacttgctccagagttcactcatttgccctaaaatatctagaccttaccccagagttaccacacaatgcatgctgtgtccctgcatcaccaaaatacaactcaaactcctcagacacactctgataaatagacatacctgacaatgtacagcttggcatcatagcaggaaaaactggctctacaacagatttattctacaacagacacactcaggctgtagagacacctaatctttctttaaggtattcagacccacccttttgggcacagtcacagatgtgatccaggataccctcacccatcccacaatactgatgcaacccacagcgtacaaacacatcccacagcataacactctaagcccacagtgctcagaaatgtcaggcacacatttgccatacagatttacttcacacacaaaaaacacagccaggtgggtggctcatgcctgtaatcccagcactttgggagtccgaggcgggcggatcacaaggtcaggggttcaggaccagcctgtccaacatggtgaaaccccgtctctactaaaaatacaaaaaaattagccgggcatggtggcacatgcttgtagtcccagctactcgggaggctgaggcaggagaatcacttgaacccaggaggtggaggttgcagtgagccgagatcatgccattgcactccaccttgggcaacagagtgagacttcgtctaaaaaaaaaagaaagaaagaaagaaacaaacaagaaaacaacaacaaaaaacacttcttatagtgcctatacaatgcaaacatgtatcccaaaatatatgaaactatttgctatgtcactcttaggtttaccccaaagcacatagaccgttttcactgctcaagctgctgcctacaaaacaggagatgccaagccatgcacagaaattcaccaaaatgcacagattcacctatcaatatacatacttgcctcacaactcacacaaacaccaccgagcactgagactcaccctaaatgtacagacaagcccttcagggcacagacttactctgtaacatactaaatcacatcccccatacttagatgtgccttatgattcacagtgatgcgtgtaaacacatagattgcttccacaatgcacagaattgcatcataacacagacttactctacagtgcaaaactgacagtgcacataaacatttcccagtcggctagacacacaacacacatattactcctacaatgtaaagatttccatcacggtggacagacgtgcttttccatgctgttgagctacaactctggcctacaacaacagaaatacagcttgtgtaatagttaccagcaaggcctctagacccatactaactgggtttgaatcaaggtcccgtcccttgctgattgtatcaccttgggtaagtatatttctttgttctttagtttgtgcaactgtaaaacaaagataagagtagtgcctacttcaaagagttgttgtgagtaataaatacgttaagatttgttaagtgcttagtacagtgcctggtacatagtgactattagaattgttaatgtatattacaaccatcactatcattactaccaaaacaaaaaaggcctaccccagatatctagaatcatctgacaacaagaaggctcaccatataatatatagattagccctagaacgtctagaaacactcgacagcacacagacaccccgccatagtacccacataccctacagaccagaaccctaaccagatatcactcacaacacacagaattgcatcactagtaacaaatttgtgcacaggcttgctctataacacatcccacaatacccagactggaagccaggctgtgtgttgtacccaacctcaccccacaaggcacaggcccacaacatacacacacacacacacacacacacacacacacacagacacacacacatcctaacctcatagatatgccctacatcatacaaacacaccctatcacacatatttttgtttcacaacatgtggatacccctgctcttcacaaacatgttcctaaatacatgctcctaaaattggcagcatcacatgataacacagagcccccattccacaacatttttttttttgagacggtgtctcactctgttgcccaggctggagtgcagtggcgcaatctcggctcactgcagcctccgcctcccaggttcaagcaattctcctgcctcagcctcccgagtagctgggaatacaggcgcgtccatgcctggctaatttttttgtatttttagtagagacagggtttcatcatgttggccaggatggtcttgatctcctgaccccgtgatccacctgcctcaggctcccaaagtgctgggataacaggcgtgagcgaccgcccctggccacaacgcattttacacttacctcatgcttgtcccataaagaactacatgccccacatcgcctaagttgcccataaatctgacttaccgaacactgccacacgtatgaccaggccccataccacacagatttgctctgtaatacctagataagtcctaacatgcagagatcacccctaaacacaaaaccatcccaactgcacagcgtcatatcacaacagacacacacactcatcccataacatgcagacttgcacgaaaacacccagactcccacaaagcaaacccacgcccacaatgctaataccacacaacgcccagactggcacaagacaaagactagcctcaactcatctagtctcaacccacatgatataaaacttgctctacaatggttaaaagcttatattcaggtctcagactgtctgagttccaatcccacatgcatcacttactagttgtgtgacctcggaaaggtttcttgaactctctgtgccccagttttctcagctacttgttaggaataataatgtaataggggtacttacctcttatagctgttaagagaaataaatgggctgggcgtggtgggtcacacctgtaattccagcactttgggaggccgagacgggtggattagctgaggtcgggagttcgagaccagcctgaccaacatggagaaaccccatctttactaaaaatacaaaattagccgggtgtggtggcacacacctgtaatcccagctacttgggaggccgaggcaggagaatcgcttgaacctgggaggcagaggttgcggtgagccaagatcatgccattgcacttcagcctgggcaacaagagcgaaactccgtctcaaagaaaaaaaaagaggaataaatgagttaatgcctataaagtgtttagagcaatgcttggtaaagagtcagcgttattggtgttacctgatcaggttgtcattgttgtcattactccacacgaaattggaccataaaggtaagactcaatctaaaacaactcgaatcaacccacaatgcatagaatatccctcataaagcacagaattgcatcatagtgaatactctcaccgctcttttcctataacacccatcccatattgactgcacctattctttttttttttttttttgagatggagtctcgctcttgttgcccaggttggagtgcagtggcgtgatctcggcttattgcaacctccgcatcctgggttcaagcaattctcctgcctcagcctcccgactagctgggattacaggcccgccaccacaagcggctaatttttgtacttttagtagagatggggtttcgccatgctggccaggctgttctcgaactcctgacctcaggtgatccacccatctctgtctcccaaagtgctgggattacaggcatgagccaccgcgcccagcctgactgtacctattccgtaacgcctagaagcatctatcatatagagtttctgcataacacctagacttatcacacaacagctagacacgctacaatgcacaacatacccaacaaacagaaactcattcatgaaaagactcatctcagtttaagcaaatgcactctatcatacacatacgtgctctacaatacacatactcaccccagaacaccacattggctccacaacacaaggaactcacttcaaaatctctagaaacaatccacaagccatagacttctccaatatgcagaacagcatcacaccacataaacttgactacaattaacagacaagaaaccaggacatgtgccataacacatacattatccccgtgacataaatactggtccagcaaaatactgtcttccctatacaacactaagatgtgcttcataaaatacaaacttgtttgacaacacaaattaaaatatttcagaatgcacatatatactccataacacacagacttgctctacaacacaccgacacaccccatatcacccagatgtgacccaaaacacacagcaatacccgataaacagtcactccttttttttttctttgagatggagtcttactctgttgcccgggctggagtgcggtggcatgatctcagatcactgcgacctctgcctcccaggttctagcgattcttctgctgcagcatccccagtagctgggactacaggtgtgcaccaccacgcccagctaatttttgtatttttagtagagactaggtttcattttggccaggctggtctcgaactcctgacctcagctgatccacctgcctcggcctcccaaagtgctggaattataggcgtgagccaccacgcctggcctcagtctctccttttaacacacagactggccacacaaaatagcttcttcctgccacgacttccctcacagcagcacatcccacaaaggatggtccacatacagagaaacacaatgtgcagatatgttctgcaacacacagccttcctggacaagacctagactcgcccggaaacacccagatccattttacattttaaagactcacatcccaggccaggtgtggtggctcacgcctgtaatccccgcactttgggaggccgaggtaggcggatcacaaggttaggagtttgagaccagcctggccaacatggtgaaaccctgactctactaaaaatacaaaaattagccgggcatggtggcgggcacctgtaatcccagtactcaggaggttgaggcaggagaatcgcttgaacctgggaggcggaggttgcggtgagccaagaccgcaccattgccctccagcctgggcgacagagcaagactccgtctcaaaaaaaaaaaaaaaaactcatatcccagattagtctgccaacccatggacatgctccacaatgcatggatagaaccacaatgcatggacatgccttacaacacatggaactacacaggctctacctttaacacacaaactgtctccataaaacacttccttgtctcttcaaaacttagtttaaaatcagaagaaatgctcaaaaatacacatagactcaacaaggcctggacataccccacttcaactagccttgtcttgtaacactgagactcatctgaaacatagagatacattatgccacacctagaatgaccccccagaaaccagactagctccagaacacccaaataggagccacagtatatggacataaccctacatatacaaatccttcctacaacataacgactaatcccacaaaacactttcttgctccataacaccaacacttacctccctgtgcatagaatcgctggacaatacagacacttcttacaattacagatatgattcacaatactaagacttgctgtaacacatgccaacttctccaagccacacagaatcacaacattgtatgtattatcggacatgtccgtatattttggggacaactgaacttatcccatgacacccaggccttccccaaaatacatggacgtgtcccatcatacatataatttccagacaacaaagactggtcctgaaaaataggttttttatttcataacaccaacgcttagctgagagcacgcagaagtgctgagcaaaacatgcgtaaaaccccacgatgcacagacatgccctacaacacccaaagtcacttcataacacacaatctcactgcaacacaccaacccagggacttaccctgagacactcagactaacacatcacatccagatctacccccacctaaccctaattgccccatgtcaccagacttacgttgcaatagccagacttgacctgcaatagtctgatttgtcccctaacaactagacaagactatccacacaatacatacaaagacccccaaaatgtttgcttgtctccacaacactgacagtttcttaagaacacacacagatgctggaaaatacacaaccaagtcctgcagcactaagatatgtgcctgtaatacctagatttgccacacaacacccagaatggccctgcaaaactccagaatgcaccacaacaagaatacatgccttgtgacaccagagcacgccttacagcagtccccaacctgtttggcaccagggaccacttttgtggaagacagtttttccacggactgggggtgaggtgggaggggtggttttgggatgaaactgttctgcctcagatcatcaggcattagattctcataaggagtgcacaaccctgatccctctcatgcacggttcacaatagggttcacactcttgtgagaatctaatgctgtagctgatctgacaggaggcagagctcaggtggtaatgcttgctcactcactgctcgcctcctgctgtgtggcctggttcctagcaggccatggagtggtactggtccgtggcccaggggttagggacccctgccttacaccacatggcgtgctccataatacacaaaccatcctaataacatagactgactctatacttacttgcctcaataacattaagacacaccttagaccacataaaaatgttagataacatacagaaaaaaacacataaataacagacatgccctataacacttacactcgcctcatagcactcaggttctcctgtgacagctggatttacccccaaaatacctagacctaccccaaagcacccagacatgccccacataaccagaaacatcacatatcactcaaacaccttccaacaatcagacttgcctggcaacccagactgtcctacaatacacagtaatggcccacagccaagagacttctcacaacttacagactggccacaaaaagcatctttttgctttcacaacatcaagactttccacacagcacatagaaacaatggacaaagttcagaaaaccccagagtgtagtggtatgcctcataacatccagagtcaccccataacacaggacctagactggcccgataagatagaattaatacccgcaataaacaaacatgccctctaatatatgaattcatcacacaacacgcacactgtccccacaaacacctttttggtgtcaagaagaaaaagactagcttcactgaacagagaaatgctggacagtgcacctgcagttaaaaaaaaaaaaaaacaacctcacagacacagcattcatcacccgaatctgttacaaagtaacaggcatcatcttctgacacacatatttaccccccagcaccagagtagctccataaaataccttcttgcttttacagtgcgaagactcgcctcatagcacaagtctgacatgctggagaacactcagacaaaatccttaacatacataaatatcacccggattccctccacaacatgaaatctaaccccatgaaacccatgatagtccacaaaaccagacacgccttatatcacccagtctagcttcacaacagccaggcataatgcaaactcgcccccgcaactcatgaaaatactccacacccaacaaaccttcccccaacacagaaacttgccgggcaaaacaaatgcaatggctcatgcctgtaatcccatcactttgggaggctgaggcgggcggatcacctgaggtggggaatttgaaaccagcctgaccaacatggagaaaccccgtctctactaaaaatacaaaattagtcgagcgtggtggcacacgcctgtaatcccagctactcgggaggctgaggcaggagaatcgcttgaacccgggaggcagaggttgcagtgttgtgccattacactccagcctgggcaacagagggaaactccatctcaaaaaaaaaaaaagaaaagaaaagaaaaaaacttcatgacactctcacaccaagacttgcttcagagcacacacaaaagatataaaaggattgaaaacatacagaacaactttgcaatgtgcagatatacagcagtactcacctcaaattacagaaagtcatacaacaagatccctgctggttccatgatacacacattccatacacagacacagacacattccatacacacacacacattccatacacgtgcacacacacattccatacacacagacacacattccatacacacagacacatattcgatacattccacacacacacacattccatacacacacattccatacacacacattccatacacacacattccatacacacacattccatacatacacacacattccacacacacacattccatacacatacacacacattccatacacgcacacacacattccatacacacaaacattccatacacacacacacattccatacacatacacagacacacattccatacacacacacacattccatacacagacacacattccataaacacacacacattccatacacacacacattccatacacacacacattccatatacacacattccatacacacacatagacacacattccatatacacacacgccatacacacattccaaacacacacacacattccatacacacacatattccatacacacacattccatacacacatacatacacacacacatacacagacacacattccatgcacacacacacattccatacacacacacattccatacacacaccttccatagcaacagacacacgctccatacacacacattgcatacacatacacacacattccatacacacacattccatacacatgcacagttacccattccatacacacacacattccatacacagacacacaccatacacacacacagacacacattccatacacacacacattctgtatgcacacacacacattccatacccacacacacacattcgatacgcacatatattccatatacacacacacattccatacacagacacattccatacacacacagacacattccatacacatacacagacacattctgtacacacagacacacattccatacacagacacattccatacacacacagacacattccatacacatacacagacacattctgtacacacagacacacattccatacacacacacattcagacacattccatactcacacacacactttccatacacatacacagacatgcattccatacacacacacacagtccatgcacacacacaaacacattccatacacatacacacattccacacacatacacacacagacattccatacacacacagaggcatattccatacatacacacacacacattccatacacacacacattccatacacacacattccacacacacattccatacacacacacacttccatacacagagacacattccatacacgcacagacacacattctgtacacacacacacaaacacatattccgtgtacacacacttccatacacacagagacacgttccatgcccacacattccatacacacacagacacatccagtacacacacacacagacacattccatatacacacacacattccctacatacacacacagacacattccatacacacacccatactcattccatacacacagagacacattccatacacacacgcacacattccacacgcacacacattccatatacacacacagacacattccatacacacacattccatacacacacacacacattccatatacacatacacattccgtatacacacacagactcattccatacacacacagagacacattccattacacacactcagacacattccacacacacacattcatacacacacacattccatacacacacacagaatcattccatacacacacagacacattccatacacacagacacacatttgatacacacacacattccatatacacacacattccatacacacacattgcataccaacacacacacattccatacacatacacagacacacattccatacacacacaaacacattccgtacacatactcagacacacattccatacacacacacacattccgtacacacacacagtcacacattccatacacacacacattccatacgcacaaacacattccatacacacacacatattccataaacacaaacacattccatacacacacacagactaattccatacacagagacacattccatacacttacgcagacacattccacacacacacacattccatgcacacacatagactcattccgtacacacacatagacacattccatacacacacagacacattccatatgcatacgcaggtatgtccccaaagaaatagattgtctccatcatatgcacattaacccaacgaaatacttttggagctctgtaacacccaaacttgactcacaacacacatgaacactgaaccacacaaatgaaacctacactacccagacatacccattgtttgaagacttgctgcaaaatacccagccttacgccatgatatacagacttggcccattgacctatacctaccttgaatcacagggactgatagagcaacactcagatgtggcccacaaccacagatatgccctaccaaacaactttttgtcttcataacatgaaggcttacctcacagaacacagaaaggatgaacaacacagacaaatcagacaacgcagaaacacatcccatgacacccagacttgctgcacagcattcagactcacactatgacactcatactcactcaataacactgattgcttcacaacatacgcacatagcccaaaacacacaaacatcatccacaactaacagacatgtcctacaatacaggggcatgccacacaattcacaaactttttctacactgccaacacttgtctcacataacacacacaaataaaaaaaaaccacaaagacatgctccatagcacccagactcgcttcactactttcagacttaccttatggcacccacacgtaccttatatcatacacatttaccctgcaacactcagcctggccacagaatatatttacatgtccatgccccacaacgcacgcacatgccttccaacacatggacacacccaaaatacacaaacgttttacacgacatacactgaccccaaagaatggcatcataatgcacaattataaccaactcagatctaccctacagaacaaagactcacctcccatacttatcacacaattcctaaatttacaccaaacactcacactcatcccaaaatgcataaacccaccccagaacacatgcagcacaacacgtagatttgccctcacttagaataaattcacagctcacacttgtcacccaatggccagacacaccttacaatgtacagacaactctttcacaacgtagacattgcctaagcaatgcacagaattccataacatcacgagctcttcctacaatggcgacttacctcacagcaccccagattgcatcagagcagacactccacccaagatatacggcttcttccacacctcctggatacacctcacaatacagaaacatgccttgtaagatatagatttctcagaaccatgaagtattgcataagaacttataagcatttctcaaaacatatactccataattaatggatacacaacatctgctcacattctcaaacacagacttgccttcctccccatcacccgctgccagcatagtcttgtgcagcaggtctaagatgtactgcagaaaacagacttgccccactctgtatggagttctacccaactttcaaattcattctacaatgcacggaccttccctcttacctatagcattatcccacaatgcagagacttacccacaaagcaaatgattacctcagaatgcacagagccaccagacctgcacccaaacacacagacatgtaccacaacaccaagaaacactccacaacatgcatatgagcccacattggtgtctccataacttccacactaaccactcaacacctagaccaacttactatgtcatacatgctccatgacataagactcccagcacagcccatggaaccccgtcacaatgaacaattattatttttttaagatggattttcgctcttgttgcccaggccggagcgcagtggcgtgatctcggctcactgcaacctccgcctcctgggttcaagcgattttcctgtctcagcctcctgagtagctgggattacaggtgcccgccactacgcctggctaatttttggtatttttaatagagacggggtttcaccatgttggccaggctggtctggaactcctgacctcaggtgatctgcccaccttggcctcccaaagtgctgggattacaggcgtgagccaccacgcccgaccgtgaacaattttacctcacagtgcaaaaattcacaaaatgccaagacttaccccacagctaatccaatattaccgtaacacctaaagttgcctgaagagccagtcatgtaccagagtactacacatattcctcacaatgcctacagtgaacctacaagaaactgacttgccctgtattgctcatactcacaccaggacatgccctataacccacagataagttccataatgcaaaaatctccctaacaatacacagcctcactctacaacagacaattattccactatgagaagaagagatcccaaatatccagccttacccatgaactcacagtcttgccacaccacattaagacatgtcttacaggccgggcgtggtggctcacgcctgtaatcccagcaccttgggaggccgagacgggcggatcacctgacattgggagttcgagatcagcctgaccaacatggggaaaccccatctctactaaaaatacaaaattaactgggcatggtggcgcatgcctgtaatcccagctactcgggaggctgaggcaggagactcacttaaacctgggaggtggaggttgcactgagctgagatcacaccattgcactccagcctgggcaacaagagtgaaactctgtctcaaaaaaaaaaaaaaagaaagaaagaaaaagacatgttatcttataatgcacaaactaactccacagtacttagatacaacttacagaggacacatgtaccctatgacagaaaggttttcctacaaacacaaaattgcattctgatgcacagatttacccccaaatgcacaaaatcactctgcaatgcaaatgccccacaaaaaaccatgtgccccccaacacccagaattaccccaggactcacagacttgcaccacaggatcaagacctaccccatattgtacggatacgctcctcaccaggcatgccttttacaatgcagcctcaccccacgaggtacccttgactgaaaccctagatacagcctacagtgtacttacccccacaacaacgtggaaaactttctaatgaaaggtgtgtccttcaatgtacaaaatatcttgcaaattcatagacattccccacagtctcagaattgccacatcattttcagactttcttccaaatgcagacttactctaaaacacttagaatcaaattagacatacagactcaacccatgtgagattctccccacagtgcactaacgtgctccacaacactcagactctcctagaacacacagaatctcatcacaacctcacaccaccccacaacgccaataagtgacctacaaaacataaaaatgtacgtgacaattcacaacaagcatcacaatgtacagatttgccgcacaacactgagacacacaccctgtcatccacagacacatcctatcacatgaaatcaccccacaaaacaagccatcacacaacacaaaaacccacagttcaagacatgcttaattataacttgacataccccacaacacacaaaattgcattataatgcaggctgaccttgtagcacacagagcggtcctatagtattatacaaacacaaccttcgcctgcaccccagaattgcctctaaccacccacattctctttacaacaccaagacacacctcatatcacatcgagaatcagcctgtatcatatagtattgcccgaaaatgcacagaattggaccgcaagttccagaaatgccatactaggtgcagacagagcctcattcctgagggactaccaccctcagaaaaaaaaacaaaccacaaacacatagatttcctgtaacgcagagacacactataaaatgcaaagattgccccatcacatggagatttactatagctgtccagaatcaacccataaaatatatagtctcaccgcatgacttcaagacatatcccacaatatacagactgtcatgtatagaccacaacacctggacatgccctacaatgtgaggacatgatccacactctgtagactacccgagcactgcatataattgaatccagaaaatcataatcataaaagtcacagcacctagaatcactcccacaaagcatgctcaccccaaaccagatgccgatgaccaactgggtccatgctttatagagatagcctatggtaaaaaggaatttgagaggtaaaaaggaatttgaggagaaaaaagaaaaaatatatagaaatatacgacaatccacagctttcccatgtgccatttatatatgcctcttcttttcttttttcttttttttttttttttttgagacggagtcttgctttgtcaccaggctggagtgcagtggcacaatcttggctgactgcaacctccgcctcccgggttcaagcgattctcctgcctcagcctccccagtagctgagactacaggcgcacgccaccgtgcccaactaatttttgtatttttagtagagacggggttttaccatgttggccaagatggtctccatctcttgacctagtgatccccccgcctcggcctcccagtgcgctgggattacaggcatgagacactgcacctggcctttatatatgtctcttttaatgtagagaacagcctcgcagtgaagacatgtatcccacttggcacagatcggcaccacaagaaactccctcacaggacctacacttccctatactttgaataacccacatacttgatcatcacccactttcctatcagaacgactcatgccaaaacataaagctcattattccaaaacacatagaaccaactcccaatgcaaagagacttcccttgtaacaaaaagatgttctctgccacactgagacttacctcacctcaccagacttgacccacaacatctagccttgcaccactacacagagacatgtcatttcaccgagaaactagccccagaacactcaggcttgcctcatggtcgttatatactcataccttagactcatatcatgatgcggaacaggcatatacagggaaaatgtaatccacaacgcacatgctcagtccacaacgcatagacttgccccatatttcacagctagctcccataattcccagacttgttacacaatactcggaaggccttacaacacctagaaaaagcagcatgataggtatgctcactctagaacattcagattcacttcataagggacaaactcagtcagttacattgaatacccaacaccatattgtttgctccacagaatatgagagagggcctacatgctcacacagagctttgacaagtgacttcatttctttctttctttctttttttttttgagatggagtcttgctctgctgcccaggctggagtgcagtggtgcaatctcggctcactgtaacctccatctcccgggttcaagcacttcttctgcctcggcctcccaagtagctgggattacaggtgcgtgccaccagacccagctaattttttatatttctggtaaagacggagtttcatcatattggccaggctggtctcgaactcctgacctggtgatccacctgccttggcctcccaaagtgctgggattacaggcattagctagcacgcccagccaacttcatttctttgagtctgtttacctatttgtaaacatggatgcaatatttacttttagactattccaaggattaaatgagataacttcaggaaagaatcaaggttcagaacatagaatttagaggcagacttgcctgcttccaatcctggctctaccactccctggggctattacctgggcacattaggtattgaaatgctctgtggtagagcacaaggaatatgagtttggtgtctgtcagacctggttttgaattctgtctctgccacttactggccatatgaccttaggcaaggtactttaattcaccaatcttcagctcctcacttataaattggggatgatggtgttccctgccttcgaggctgttgtaaggattaaatgatgcctggcatcttaatctaacaagcaagaatgtacaggcacagacaccgactcacacccaatgcgtgaatatatgtatattatgtacacatggatacatagacatgcagaagctcacagagatgaatatttgcaagcagtaaacataaggacaaaacgtccacatggacacagatgccattttgtatgcctggactcgtgcagagataaatacaggtgaatacagatacagtcccacaaacttacatatgtacacctagacatggctacagcccccaaacaagacaggatttcacccacttaaatgatgacacactcaaaacccccattacaggcaaggcgtggcagttcgtgcctgtaatcccagcactttgagaggctgaggcgggtggatcacccgaggtcaggagtttgagaccagacaggccaacatggtgaaaccccgtctccactaaaaattcaaaaattagctgggcgtggtggcaggcgcctgtaatcccagctacttgggaggctgaggcaggagaatcgcttgaacccgggaggcagaggttgcagtgagccgagatcgagccattgcactccagcctgggcgacaagagtgaaactccacctcaaaaaacaacaacaaaaaacaaaaacaaaaaaaaccattacaggcccatgcataaagagctctataaatgtacttgcatatatagacatttaaatgcacaggcagatgtacactcagatgccatgtatacccacacagaaataccgaagcagactacatcctaagcatgtaagagacatacacatatatctatagataatacctacctaaacacactttagacatgcatatgtacatatagacatccactggcacacaaatgcacagatgtacagacttgcaccctcacgtgtcaacatacacacacgttggcatgcacatatccacactgttctacaaatctatgttcgtgacatacaagtcctaaatgcacattgaatatatgtatatacacgtatacatgtgccagtgtaggtatatggatgcatttatagacttaatcatgccacaaacagaaacagatttacacacgcacagacattagagacacatgcaatttatacatatgaaaagcagagacacctaaccacgaagaagcacctttacaaaggtggctatgacttttttttttttttctgagacagagtcttgctctgtcatccaggctggagtgcagtggcgtgatctcagctcactgtaacctccacctcccaggttcaagcagttctctgcctcagcctcctaagtagctgggattactggcacccaccaccacgcctggctaatttttgtatttttagtagagacggggtttcaccatcttagctaggctggtctcaaactcctgacctcaggtgatccacccgtcttggtctcccgaagtgctgggattacaggcatgagccactgcgcccagccgaggctgtgacttttaacgtgtccttgtcttagtctcttcaagagagaatgaaaattatcaagctcctgctaaatacactgtgtaaaagtagatgtggacattaccagaaggatctctaaaagattttgagttcacatgtgagtatgcacacacctcacaaacccacgtgcacatgcgctttcgcgtgcacagaatcagagatatagcatcacatggaatcacagaaatagaaacatgtgcatagccacatatagaaagatacatggacagacacacaccccactgaaatgtcaaactgtaatatttaaatgcatgtctattgaagttaaaaaaaaaaacctgcatttttatcccagctccatcacttactagttcaatgatttgaggtcattttcttgtcttctcacctgtaacatgagagtaatattagcacctatcttttagagttctttgaagatgtagtgaaatgaagggcttagcccagtgcttagaatgtcatagatgttgctgcttattgctgttatcttttggttttggtacaaagtgcttagctagataggatttggtttttgtggtcaaactgcatgattatatcatagagatgtattaatcaactttttttgtaaaggtattaataaagaataatttattaatgtaatatagattacatccacaaacaaggtcatttctgaaattctcagcggtgataagggattattactgtctctggcaaatggaaagacctgaaacaaatatttcctgctagtgtggtttgttgttattactgtcgttagtattcttttcctcttttcaggaggagatggaagattgagagcagagtgcaagaatgggaagagggcttcgtgccctgtgcacgtttgccacctagtgaccaaactgagtaagtaccgtatttgtggattgctcagaaacgtccctaaaacttcactcattgcaaggttgtgtaaccaccctggtgaataagcacgtatacatcaagttatagcgatttctgctacatatgtagaaatttttaaaaagtcataaaataaaaagaaatctttctctctaacttttccccctgccgtcccaaatttccccgtggaattcattgagaccgtgttctatagcagtgatctttgtactttctaattatttaccacctaacatcattttggaaaatggtctactccatcacacatcttgaagtgaacacctgaaatttcttatcataaatttaagtatttgtaacatatttccagcatattatgaatactccgacttttaaataaattggtttcatcaaatttttgcatgcaatgaaataaaaataccatacccatttgatattcataattgttgatttaaaaaaacatgaacaaggtcttctttagcagtcagaaattttacgtaatgtttctatctccttgaacttgccattccattcaacttccctcacataatgtataataatgaatacattttcaatatttaaaggccccttattcgtcaccttaccatacatgcctgcaaaaagcatacaagaattgaaaaaaaatttctgtgactctatgcctcaaaagattaaaatttttatcataaatttattagtagtacacaatcagaagaacttaaaatattacacatttggtaagtaatcagtaaaatgaaaagtaaaattggttggaaatacatcttttttttttttttttttttgagacagagtcttgctctgtcaccaaggctggagtgcagtggcgcaatttcacctcactgtaaccgccaccttccaggttcaagcaattctcgtgcctcagcctcctgagtagctgggattacaggcacgtgccaccacgcccggctaattttttttgtatttttagtagagacagggtttcaccatgttggccaggctggtctcaaactctcgatctcaggtgatccgctcgcctcagcctcccaaagtgctgggattacaggcatgagccaccctgtctggccaaaaatacatctcttaagtgaatatgattttattttccccaaactaatttttgaatcggagaatgactcttacttatttctaatgagccagacttcagttcctgtccttcatttttatagataaaagaactcagaaaattttgttcccataaataatcatgtagtgacctgtcatcaaaaataatttttaatgattaaaaaaattttaactaaatttttgatgtttaacagacaacttgattagacccatctttaattctgtgaaagcaaagaaaccctctgatttactaaaggatttgttgttcagtcactttttttctgtttctgggaagtttactaaaatggctttccccaaatttattacataactattatatgttatattttcatttgaggcattatttaaaattcattatacacataaaaggttgtgaaaatcaaagtacttagatcaatatgtctttgccaatacgataattttgataaaatggtatttatttatttatttatttatttattgagacagagtttcgctcttgttgcccaggctggagtgcaatggcgcaatctcggctcactgcaacctctgccttccgggttcaagcgattctcctgcctcagcctcccaagtagctgggattgcatgcatgtgccaccacgcccaactaatttttgtatatttagcagagacggggttttccatgtttgtcaggctggtctcgatctcccaacctcagatgatctgcctgccttggcctcccaaagtgctgggattacaggcatgagtcaccacgcccagcctttaatttattatattctataaatataagaacttgaggctacagatttgaattaacaattttataggaaatattcataatttatttggcaaaggcagtattcatataaaaataatcaacaaaatcagatttactttcagaaaaagtgtctgacttcatttttcaaggaaaaaatattaatatacgttttgaggtgcattattaaaaccatggataaatcaattatggagcaccttgttaaataactagcaaagtaaatatcatattaaaataaatatgaggcttttatccacttcaaaataaattaagaaattaaataataactttgtttctgatatataattttaaattaaacaatgtagtatgtggttaccattataagtcatacatgaaacaaggaatctgaaggtaggcagaatttctcatgtaaatatgtatgtatgtgtttttagaacattggagttgaatttcttggaataattgactaagaatagcatatacatttttttttcaaatccataaacttcattagaccatagaattaaagttttctttttcttttcttcttcttctttttttttttttttttttgagacagagactcgttctgttgccagcctggagtgcagtgagttgatctcggctcactgcaacctccccctcccaggttcaagctattctcctgcctcagcctcccgagtagctgggattacaggtgccctccatcacgcccagctaatttttgtatgtttagtagagacggtgtttcaccatgttggccaggatggtctcgatctcctgacctcgtgatccgcccatctaggcctcccaaagtgctggcattataggcatgagccactgtactcggcctagtatcaaactttttaacgatattttatgaaagagtctaaaaaatacttgctaaatataaaactagcatatcattttatttttgataataggaggtagaaagtataaaggttatttataaaatgaaatgaagattgatgcttttttcttttttctttttcttttcttttttttttttttctggagtcagagtctcactcttttgcccaggctggagtgcagtggtgcaatctcggctcattgcaccctctgcctcccggattcaagtgagtctcgtgcctcagcctcccgagtagctgtgattataggtgcgagccgcgacacctggttaatttttgtctttttaatagaggcagggtttcaccatgttgcccaggctggtctcgagctcctagactcaagcaatccatttgcctcggcctcccaaagtgctggcattacaagctttagccaccgcagtcggctgaggattgattttaattggaaaagatattttacgatacagtctgagaaaacaggttctaacaagtttaatacaatgatcacataatttctgaaataaattacataatttcttatttaatttttaactttttaaataattttgatacatttgtacatacttatgaggtacatgtgaaattttgttacatgcctagaatttgtaatgatcaggtcaaggtatttagggtagctatcacctgagtatttatcatttctctgtgttaggtacatttcagctcctctcgtctagccattctgaaaaacacaatgcattgttgttacctatagtcaccttactatgctatccaacactagaacttattccttctatttaactgtgtgttcgtatcaattaataagcctctcttcatccctcccctcctgcctatacagccttcccagtctctggtgtctattattctactctctacctccatgagatcaacttttttagctcccacatatgagtgagaatatgtactgtttgtctttttgtgcctggtttattttacttaagataatgacttccagttccatccatgttgctgcaaatgataggatttcattcctttttatgacccagtagtattccatggtttatatgtaccacgttttctttatccattcatctgtggatggacacttaggttgattccatatctttgctattgtgaatagtgctgcaataaacatgggagtgcatgtatctctttgatatattaatttctattcctttaggtaaatacccagtggtggtattgcccatttctatacataagttttaccaaagtctaaatattttttagtactagaatacagtccaattgtgttgaaaagaatcagtgtcagcaatatatactgcaactagttaggagatgctcttttttttcccagttgatgacacacgtttgtgattaatgttgagaatagatggaaaataatgcttaattttaagcatgtgggaaaaaatggtgttcttaggtagattcattttaagagagaatacacgtaagagttgagcacctgaaagtggattcattgatactgttcctactcacatacttcttgaaaagaatttgtgtaacagtagcctagtgtgaagaccaccgttctagtctgtctcctgcaagattgttccagaacaatatattgttgtaattgttggaataacccatttattgtagtttatgttcacaaccatgcaatggaagtagttgtcacttttgaatttctgccagatgcttctgtgagtgatcatgtttgagcaaaatgtcctggaagggatgtttttgttttgttgataaatacatattttgactaaacttgttttgtccagtttgggagccacaatcacatgtggctatttaacatttaaaatgtggctagtacaaacagatatgctgtaagtatagaatacatactggatttcaaggacaggacacataaagtatttcactaatattttatgttaattacatgttgaaataatattttgatgatatagaattaaatagtacatttcactaaaattaattttacctgatttttagacttttaaaaaatgttgcaacaagaaaatttaaaattacttgtgaagctcacattgtatatattatatgacagtgctggtctaaagtttatattggaaatctctctaagtttccctaaaaccacttctatggaaaaaattgattttccactaatctggttcagtatactgctattctgatgtaacgtgtgccttttactagtttttgggtttccatattgggggatttttagtagtaagcaagaaaaagtttaaaaagtaatattccagtaagaatattggaaaaaacatctattagtacctagacgctttcccatatgaactttgaaaggcttcttggtggttacatgtgaagcttttcagactcttcataattccagtggtggataatgcattctattgaagacatgaagtatttaatcacatctgatttctttttttttctttttgagatggagtttcgctcttgttgcccaggctggagtgcaatggtatgatcttggatcacagcaacttccgcctcccgggttcaagcgattctcctgcctcagtctccctagtagctgggattacaggcatgcaccaccacgcccggctaattttttggatttttagtagagatggggtttctccatgttggtcaggctagtctcgaattcctgacctcaggtgatctgcctgccttggcctcccaaagtgctgggatcacagccgtaagccgccacccccatccacatgtgaaacttttttatgtaattatttttatgtaacattaagagaaaaatacacttccagataaactatgatgtaatgctttcatattcatagaattttaattttatacttactaatgagctcttttagacttatttagatatatatttttattatgtatcatgatataacaacagccgtgaccaaatttgagcataaacagacaatgtctacccctattcaaccaccttctggcccacagtgactgtaaaattccattgattataagatccattctgatttcagtaatatgaagtgtgattaaaaaaaaatatgcatcctagaattgattaaatacaccaagtcatttatcaagagaaaaggatcatggagggcagaaagtcaaactggaagacattggcctaatgaaaacaccttttctatatattatcgtatttacaaaacttaaaatgtgattctctttaaaattttatcagagtcctcttaaataacatttcattatacatctcctcataattggtatttcatggttttcctggcattctgttctttgtttcctggtttggaagtgggagggctagggaagaatggtgacatgtggggccagggctgggacagaccagatctctccagactgaaaaggtctagtacctccattgggagaactgcttagcactgtcttgtgtgaagctatgacttcaatgactctgtttttcttcataagtaagctgacagatggagttctcctcgtcaaggcttagtttagtcttaacataatcagtataccttttcttgactgaagggtctaagaagggaaggaatgaagattgagcagcttctctagtttttgttttatattatatttgggaggtcagcaggatgcatcaaaatttcacaggaagtacattatctcaagaatcaataacataaaatcgagatttgtcaaccaggaattatggcacatccctgattctaatgatactcttgatgatatgagatttacaagaagtaacaaagtgaatgttttttttttgcaacgagaagaataagagaaccaatgacctgttttctctcttgtccctacagtgaaaccttacattaagacttaggtatttcttgagggtttagaagcaaggccaacttcatgagcaaaaggggcttttgcacagggccccttgcttacaaaggttccatacttggcttaatgctctgctgtcactgtcttgaaattcttaataatttttgaaaaaggggccccacattttcattttgcactaggccccaccaattatgtagctgattccattcaaaaggagatacttgccagtgaacaattaactgaagatgcaaaataaaattagaagcattcctcatgtgcactgaattcttgctgtcagctcataacataggattcataagctattattgctgctattgtgttgttaggaatcatagttgtagaacaggggtagttagtacaactcaacagtaccttatattgactccttatttttccatgatacaacctggggcatcttctgtgtttctagtttctcatctataaaatgtctgtgacattacacttgccctgcttaaccccagataaggcaattgttagaatcaaattgaaattccagtgaaagtacattgtgacctgcaacagttgaaacagtaaaggttgaaacagatgtaaaagatgatttattcctctctagagcttggagcctacgtggcaagcaccagccaggggctctagggatctgaattagactcagtagtgaggctgctctgacccatgaatacagagtaaatattccagtgggtactagagccaggaaatcatgcctttaaaatttcaagagtccaaccagggcatcccactgttgtcaaaagggctgggttgaggcacctggatgcaaattgcagaaatgcacatagggttagagggtttggaagagagaagaggaagtgcagcttgaagagatcctctgagccactggggcatggtcacaagcacttgtcttggacaccaagatgaaggagggaatggccaagggtgcccgccatctcagactaacagaagttttcctgttacccagaagagaattgtattcagagctgccattacctgagtaaggaaaggactcttttgtctctattgtatgagggaactcattttcttggttgtaaaggggaatagctcataatagagaccttggggaagtcaggaaataccagatggctccaaatgcaagaatgcctatagatgattgccttctgtagtacatcctgaggtcttaaacaattacagcatcttgctatgaaatgcaatggacagaggtgaaagtagcagttcagatgaggccacagaaaatgccagttgaaagatgatttgcaaataatcttggcaatgctttttctcactgatgggagatggcgaacaacagtttgctttatttcacactgtcccttcggcattgctggcaaaatgggcagtgtgctcctccctgtctctcagctctcatcagtcccaggtaatcaacttaatttaacctcactgcatctttgtagggaacttctaatctatctttacagtaaatagactgaatatattggttacatcttacctaaagaaagctttcccaggggcactttgttttgcaaaagtttattggaaaatttttgtgtaagttggattatggttaaaattattgagtggagcttattaaaaggttttgtgctgaatatcttgaaaaaccaccaattgtacctgatatatattttttaatatgtagggctcttagcttgattagtgtagggtacactcttgggatttctatgagagaggaaggtcaaaatcttcaagtaagtgactttcctattggcaaagtgaggattattaattcacggttaatttgagctttgctcttagatttgtacattgaatccagggtactcaaaagcggacagaaacacttttatttttcctgcatccccccaggtagatccaagtagacaactttttaactttcctttttctgtactatattttgccctactgaaatgtggtctcttttgcaagtacataaaaaaaatcaaactacttaaatcccctaaagagagagtatgcattcaggcagtgattctatatcctgagatttgttcatattcatgtaggcagaaaattccggcacgacaacaaggtatccctctaaaatacgtatatggaaagcaattagtgtgactttgagctgacaaaacactcggtgaatagcagaaagaatatttcttggtaaggccttatggtagaaggtgatagagagagagagagagagagagagagagagagagagagaggaaggaaggaaggaaggaaaggaaaggaaaagggaaagggaaagggaaaagaaaagaaagtggccaggcgcgtattggctcacacctgtaatcccggcactttgggaggccaaggagagcggatcatcagagatcaggagttcgagaccaggctagccaacatggtgaaaccccgtctctactaaaaatacaaaaattagctgggcatagtggcgggcacctgtaattccagctattcgggaggctgaggcaggagaattgcttaaacccaggagacagaggttgcaatgagccaagatcacaccattgcactccagcctgggcgacagagcaaaacgctgtctcaaaaaaaaaaaaaaaaaaaaaaaaaaaaaaaaaaaagaaatagagatttatatctggtaaaatgtcaggtatttgttattaggtcattttgattagacagggacacgcagatgagagacggagaagtaacaggaagttttgacaaacttcgacacttggaatcagggcttaaggatgatagccgcaagcttatcagcttctgcagtaagagagtttttttatgtttattctgctttaattgcacagtagtgagacaatccctttctaccctgaatagtaatgcatttcacttgtccaactttatattacccaacatgagttgcgtgtgaatttttacaaaaaaaaaggtaaagacagccttcccaactaatgatacagttataagacattaaaatatttgcacagagaaagcaagaaaatctttattatggggcttgcacagagtctagttaatctggcagtattcatgtaccatattgtgaagatacaagcacgtgaccctgcgagcagttacatcaatagtcattttgaaggatttttgctgttaggtacagggaagccttccccaaaagaaagtcgagaggctttccctccacctcctcctcttgaccttggagttgctaaaatttttaggtgttgctactgactgtgtagacctgggaatatcagaaattgctgaaattgtttcttgtacgtgcagaaagaaggataggaatgtagtattttaggagtgagcattcatgaaaaggctgtttcctggctaaaatgatacagtatatttggttgcatatttctgttgggaaatgaggaagaggggtttattgcattgtgtcagaatgcaagggtaaggtaggtaggagtatttgcatcattttgatttttttgcacctgagtttgtacactaggttcaggctgccacaagggctgcaaacctggcaaaccaatagcaaagagccaacttctgatctgttactggttcagatcagagacttccagctgcttcacaacttggcttggggaggatgagtcacaatctagatcagttagggagataggaggtaaagatgtggttggacatctgcatttgtggtaaagagagcttgagcattacttctaaacctgtgcattttgagaggctttcatcacaaaggagcccacagaggggagttgattgctgtgcagaggtcttggttcaagcataaagatgcttgtatgtgagaagctggtagtgggaaacattctctggagggctttgtgagctagatggatgattgtcatctgtgcaggtgcctataggtaaattaggtcaagcccagctctagtttggattagagcttttttttgggggggggggtggggggaggagatggagtcttgctttgtcgcccaggccggagggtagtggtgcgatcttggctcactgcaacctctgcctcccaggtgcaagcgattcttctgcctcagcctccctagtagctgggattacagatgcacaccaccatgcccagctaatttttgtatttttagtagagactgggtttcaccatattggccaggctggtctcgaactcctgaccttgtgatccatttttccacccccgccccaacccggcctcccaaagtgttgggattacaggcatgagccaccgcatccagctggaccagagcttttttaagctacctgcagcattgtctaaaatccctgctgtgttcccagaccaaccaagagaggccacacctgtcagcgaaggtaggttgaaagctaagcaatgacctcacttatgatataggaaaaatttccagtgcttcccctagaccccagttgagaccgaggacaagacaagggaaggtgatgatatagtcttaagagttgcaaacaacccttaaaggccatttagtgtaatcgctatatctcagttttgaaattcccaataaaatatctctcctacctctgcttgaacatctccagtactggggagcttggtgttttctaaggtagcccattcagtctctggccatattcattagataactcttcctcacattgaactgaaatctgcctcctttgatagaggttctgatctcttgggcaagtcacctcctgcggatatatgacccttttgatacttgaagacagcacctatgtttcatttaactctttgcttagctaagtttttctcaatcctcatttgacaattttgaggcttctgttatccatgctttttcctctcaacagtccataggccagggtaccaaagtctgacatagcattcctggtgagtctgaccattcattccctaagctgaacatcatttctctattgaccacatgacatggtcagattgcattgtcgattcagccgtagtttccagacagtctaaacccagctggaagatgccccaatgctgcttcactaagaactacagggataaccagtgcttccaaccaaaagtatttcactactgaatgtaggtcctggtgacacagcaagtaataaagtggagggtagaaagttatctggttatattttttgttgataactttagtgtctatttttcttccctatattatccctagtttatccactggtcatttcatatgctgcctgggaccaggcccaagaaaatatggaaaaatgcaacttacataagattgaggaattttattagtcatatacactgctcacaacaaatcaggagtgaacttgaaactgcctttctctcttcacgcctccctccccagccacagtgttaggaatgaatgacactgcctgcaaatagaggaaaagagaacttggtcacttaaaaatatagcattctaattttttcttccactaggttagaaaatatttatttgattaacaaactgtagtagtatatatttatggggtaccatgtgatgttttgatatatgttgacattgtggaatgattaactcaaactgacaaatccattacctcacatacttaatctttttcgtgttgaaaacatttaaaatctactcttttaactacttaactttttgtggtgaaacatttaaaatatacaatgcataattatttattacagtcaccattctgtgaaatagatcactaaagcttattcctcctgtctaactgaaactttgtatcctttgatcaacatctcccctttccccgttcctctagattttaactaagtttgttcactacatgggctaaaaagtgcgatatattctttatctaattaactaaataataatccccagtagaatgtaaagaaaatgtgatttggcagatttatgcttcatatagttggatgagagagggatccagtgtgaagttacattttgagaatattcacattcctgatggatttgtacaagtagcacacatcacaatgatcactcacttacaatcatgtaatcaacacttcatacaagggctaaactaaaaattataagataggtgacagctactaatgtatttatggaggcaacagaacaaactatttggtattagaaatgtgttgagtaaaaagagccgtgtgcttgctgggagcaactaatgaagagtttgcttacattgtcccatatttatgattatgtgttctatcaccctcccactccacccgtgacatttactatatttactgttctaactcctttcctgagactggagctcctgcagtatctaccttacaaactgcatttcgtcacacacactgactcactccaaagccagtttcaaatatggttccttcttttggccctaagatttgaaagacagggcatgtaagtttctaaagcacaactgaatccatcttaacaaggaaaggtaaatacattttccctgcagtttcaaaattttccacaataaatgcataggagttttcttagtaggaaaaataataaatgcaacaaaaactttgttgtatttggaagtgttctgaaaaaacatttaggtatggggtaagatgggctggaatttgcatttttttcaaagtttggaaatctctgaactgatgaataaagaattacatcgggctgggcacggtggctcatgcctgtaatcccagcactttgggaggccaaggcgggtggatttcctgaggtcaggagctcgagaccagcctggccaacatggtgaaaccctgtctctactaaaaatacaaaaattagccgggcatggtggctggagagcctgtaatcccggctactcgggagattgaggcaggagaatcgcttgaacccgggagaaggaggttgcagtgagctgagatcgcgccattgcactccagcctgggcgggaagagccaaactccatccaaaaaaaaaaaaaaaaaaggaattacattggccttcactgaattctggcctggcttttcatgcagaacagtacaggcattgtaaacatgtgaagccaggtgtactggctttgatttttgttttcctccagctggcagtgggctaggatggctgtgcccaactatcttcactaagagttgccttatttttgaagacgtggaattagctatggaaagcaaaattcctctggctgtgcctttggtgccttgacctatttggccacatcccatccctgccctggactcttctctcctctttgtccaacagtttttttctgagacagagtttcactcttgtcgcccaggctgaagtgcaatggcgtgatctcggctcactgcaacctccgcctcctgggttcaagtgattctcctgtctcagcctcccgagtagctgggcttacaggcgtgtgccaccatgcccagctaatttttgtatttttagtagagacggggtttcgccatgttggccaggctggtctcgagctcctgacctcaggtgatctgcccgcctcagcctctcaaagtgctgggattacaggtgtgagccaccatgcctggcctatccaacagtttctaaggaccagagtagacagtggatgacaacatcttatgcagttaaaggggcatttcatgatcctttacagataaacaaactgggatagaagaatataaaatattaacttccaccccaaaagaagccacctcatttttgttttaatgaaagtttgttaaagtgatgaggttacaaattaatataaatgtttgggaaaatatgcttcttgtttagagaaagtgggaccataaaccagcaaaagtatttcactgaatttcactttaatggctgcaggtgaacacttgatctgagagtggtacagatctctttgtctttctattcaccctctttctcttccctcaacctaatcagttaaaggtcagctctctgacataattgcaatccattttattcagacaatgaaacatcttattattgagtgccagataagtaccccattgctatctaccatcaaacaggaagtcagaaaataaattcaacatctaactccactattaactagttgggtgatctttatctcattgccagttttctcctttttaaaatgggaagaacaacaatatttgctgtggcttcttcacagggttattgtgagggcaagtgagaaaataggcataaacacacattataaaataaaatatgatatatatattttatatatgatatattttatctatgatatattttatctatgatatatatattttatatatatgatatatataaaatgtatataaaaatatataaaataaaatatatatattttataaactaaaatatgatatatttatatattgtgaagtattataattgttaattgtaataataagtataagtaactttttagatgtggaagacaatattgcatttaatattagtggcatttattggtccagtgaaattattacaactgtagattttagtgtatacttctgattctcagataaaatttgcagacatgttttgatgtactttatgaagataagagtaattcagctgaattagactctagctttttcttacaactggtcacttttcatgagtgtaaaaacaggtggtttatccaattctgaaataccttttaggtgacaaccctgtaacatttcatatgtgaggcggttgtctagatgttacattccagatatctatagtttaaagaatataaaactttttaacattaggaatttgccaaaaacattctgtaatcatcctgagtaacagggatgggaaagtttttgtgatacgttttattttctctaatcttgaagttaaactaattggtccaatttttaaaatagtgaataacaaagactggaggagccagaatagaggagcaacttgaggctcagtgaactgcccagatatcaaggaagaaggaggcacacagtatgcagattctccaggggagaagacttagagtctctacaaattataagaagtaggggaggaggaaagacagtgatggaaggaggaagagaagtaatgtttgtgggtaactacttgacaagtattttaagttttgcagttttaatttagtttagtttaattgaatttttgagacagggtcttgctgtgtctcccaagctggggtacagtggcacagtcaaggctcactgcagccttgacctcctggactcaagtgattttcccaccttagctgcctgagtaattgggaccacaggctcccatcaccttgcctggctaattttaaacatttttttgaaaagttttttgtagagacgaggtctccctgtgttgcccaggctggtctcaaactcctgggcgcaagtgatcctcctgctttcgcctcctcaaagtgttggtattacaggtgtgagacaccacgcctggccaagtttggaagttttaaaaacatgttctacaagtccatcaatgaatgaatagataaagaaaatctggtatatatacacaatagaatacaattcagccataaaaaagaaaatcttgtcatttgggacaacatggatgaacctggagaacattatgttaaataaaataagccagacatagaagataaatactgttttgtcttcatatgtggagtgtaaaaaaagttgaactcatgggagcagagagtagaatgatgtttgccaggggctggggtaaggaggagacgtttgtcaaaggatccaaaatttcagttagacaggaggaataagttcaagagatctattgtacaacatggtgaatgtggtgaataacaatatattgtattcttgaaaattgtcaagagtagattttaagcgttgtcaccacaaaaataactatgtgaggtaatacatatgttaattagttaacatatgtaatatgtaatacatattaaatgtattacatgttaaaatgtaatacatttcacactgtatacatgtttcaataaagcatcatatacacaataaatatatgccatttttggtcaactaaaaataagttaatttttaaaaaccatgtctattgatagaggactgttttttatttcaatagcttttggggtacaggtggtttttggttacatggataagttatttggtggtgatttctgagagtttggtgcatccgtcacctgagcagtgtacactgtacctaatatgtagtcttttattgctcactctccacacatcctttcccggtgagtctccaaagtccattatatcattcttatgcctttgcatcctcatagctcagctcccacttattagtgggaatgtacaatatttggttttccattcctgagttacttcacttagaataatggcctccagctgcatccaagtttctgcaaaagacattatttcattgtttttatggctgagtagtattccatggtgcatatataccacatgttctttatgcattcattggttgatgaagacgtagattggtttcatatttttgcaattgtgaattgtactgctattaatataaatgtctgtgcatgtgtctctttgtataattgcttattttgttttgggtaaatgcccagttgtgggattgttggatcaaatggaagttctactttcagttctttaaggaatctcaataccgttttccatagtggttatactagtttacattcccaccagcagtgtaaaagttctccctttttatcacatccatgccaacatctttttttttttttttttaattatggccatttttgcacaagtaaggtggtatttcatggtggttttaatttgcatttccctgataattggtgatgttgagcattttttcatatgtttgttggctgtttgtatatccgatagaggactatttaatctgggaaataatcaccgtgagaccaaagcaagatgcatatgatataaaataagacttcataacctaaaccgatctgccagtgggaagaatacattttgaagaggcttcagtgtctttccatggctggatcaacaatctgctgaggtagaatttcagaggaaacaagaatagttttgtagtcaatgcagggtattaagggcctcctgaagagattaaatgaaaaccttattgtagtccactactactttattaatgtggcaggcatattttgcttttcaaatttttcatttaatcttgtatttgtgaatattactaaatgtcttgggattaaggacttttaaaaagccttgtttacaaagcccgttattcagttccctgcagcaactcagaaaggagtctatatatccaccctacaggcctccttattacatagaagtttaaaaaaggaaaaggagagctggaagttttaggaggaacttggccaaaaggaagagagatgtttgcaatcgctccttcacctttgccacaaccattttcatatccctctcccttgatcccttggtgatgattatcttagggacaggacacagtagtagctccccctagctctggcttcttccagttctttaggcttttctcccactctgactgccactgcctttgcctgtggtgctgcttttcctcaattgggctgtttaaagcccatcccatctgttaaagctcatctcaaatgcatccctgtcatcccttccaccatgagcaagaaacaaatttttcagcaatctctgctatttccacgtctgaatagtcagtagcgacatcacaaaatcctgtcaactccaaggtctggaggaggagggagagggaacaaagcccctagatgttttgtgaggaagggcctgtctgtctctaacatcaacaatacttcacttgtctattgggtccaaccaccaggcatagtcatttgcttatatcttcacaatgtggtacatgaatatggccaggttaactgggctctgtgcaagccccatggtaaagattccctggctttctctgtgtgaacagcttgtaaaagtatcattgattatgaggctgtttttcactttttttgtaaaaaactcatgcccaaatcatatcaggtaatgtaaagctggacaagcaagaatgcattacttttctaggggaatggaaattttctcaccactgtgcaattaaagcagaataaagagaaaacactcttgcttcagaaactggtaagaccttagctttcattcttagtcctgatttcaagtatttgagtttgtcaaaactgcctgtcacttgtccttccctcatctgtgtgtccttttctcacatacatctactcaaaatgatataatgactacattcaactgggagcctcctgagttaattcggccctttagccatctcatgcttagtgtgctgaaattgatggttgaggaggcatcaaataagctatctacatcaaataagcctgctacaaccagaaaaaaatcccaacaaagtaagaattagttattttaattatttaacataaaatgtaaagtttctgatatatttggctagatgatatgattaaattgctgataacataattttgtttgttacatacataaatagaaaaggaagatcagtttctttgttgttttcaggattaaatactttttcgaaaattaagaaaagggaaaattaggacagatgccaccttttcaactaccagtctctttcaggatagtgagagcagactaagattccagagtctgtactaattagagtctatgctactaattatcagtataatttgggataagccttccactcttgggcctcaattaccttgttagtagatcaagacattggaccaaatatctatgggcactttcagctttgagtgtttgtaacttcgtgaaacatcttcgcctttatttttttatacagggccatgttggagtgataaccaatagggaagtaacagccatatacttttggggggtatgtctttgagcataatctcatggtggaagagtgccttagcttctagagctgtgttgtctagtaccgaggatgtgctatatatggaaaatacgtaccacatttccaagacttcttctgaaaattttataaaatatcccgttattttttatctttattatatgtggaaatgataacattttggatatgtttcgttatatgaaatacgttataaaaataatttacctgttacttttcactttttaaaatatgctattccaaatattgaaaatgatacccatggtgcctatatttcttttcttttctttctttctttctttttttttttttttttttttttttgaggtggagtcttgctctgtcgcccaggctgaagtgcagtggcatgatctcggctcactgcaacctctgcctcccaggttcaagcagttctcctgcctcagcctgccgagtagttgggattacaggcgcacgccaccacgcccggctaatttttgtatttttagtagagatggggtttcaccatgttggccaagatggtctcgatctcttgatcttgtgatctgcccaccttggcctcccaaagtgctgggattacaagcgcgggccaccgcgtccggctagctcctatatttctattggacaatcctggtctagacagttattcctgttatatttgacctgagttccagttcaaaaacctcccaaggttgaaaccatccaaactagtggcacttagtcttggatgcacactggaatcacactggcatattatgaaaaataatgatcccttcctccccatggttctaattaaactgactcacagtgacctttcttatgtgctctgaattttttccataaggccatgggtggtgtaatcataaaaaaaaagactttgttatatgaatgccagaaacttgtgtacatccaaattggacagctactggattaagggggcatgaatcactgaagcaggctgagccctgactcttaaccagtctcaagggcaaaactgtttctctcttcagtactcaaaaatctagcaaacagacaggaaatcgtaccttgaattaattctgtcttagctgctgcttcttgtttgagtttctgaaaatcagcttattatactgcatcttgtctcccagggagatacttgacattgcttggtctgttttcagaggggaaaatggagctcaaggagtgtggctatctcctaggtaaagaaaatttcttccagcagatttttttttttctactgggggatttttttggactcctaatatattgaaggaagtaaaagtagacaatgtggcttgatagaaattggacggacctctaacatggagcaagcagccatcgatttcatgttgatttctgatagcataggctgttttttttttagcctcaccctcaaattttggggttcaccctcactgaagtctgccatccctatatgctcataagatctatagttacttgtggttgggtcctagatatgggccttaggtaagaagggaagctgctcctttcctttcctagttgtcctcttgattctcagagccgtaggtacttgcccaacttctatggttgactaaaatcggagtcccggtaatgaatttagaacagattttcaaaataactaaaaacctaggcttttaaatcagactctattgaattgtatcttctgatcctggtaagtcacagaacttcctgacactacaggtgcttgaaaaagaggtgctgagctactgtgatcatgaatgtccatatttggtgccatctttagtggtggtaatatcttggcaaggtagtagagagttgataaaagctccagtaaataatcctgtgtgtccacagtgccttaaaactctaccaatcctctgcccaaggtttttgatcaaatactacttccctgagtgcaagattaagttaaaggtgtattcgttgtttgagttgttttggagtggctctgccacttactagctatatggccttgggtaagtaacttaacttctctgagctccacttgtaaaataggaatcataatatccactgcatagttttgtgaagctttcatgagttgctctacctattttccacactttgcacggtgatgcctccagaacagaagctaaagaaatgtttgtagaatgaatagatgaatttatgaatattaatcttgtgaaagtatatgcttacagaattgccctctgtttgggtcagtctaaaggtaccagagtttaatttggtagctaattgtcaaagcctaattagtttctctatcaaatacttagactcagcctatctccattcccctggcattttcataaaatagaggctagacattgatgggaagctgggaaaagcaccttctaccacagtacacattttgcagagatagagatattttaggggggtcagattgtccctaaatatgaaagataaatgagggtaagttctagtcaaatataaataaattttactaaataaggagtcattaaaatggacaagtacatattggatcagtatttaaatattattgagacatgtacatgtaagtgcttgaaaaaaaagtagaattctctgaactacttatataaacccctgcccaaaatagaacaataagtaactagggcctaacttttttagaacagctgtaaggggatagtactattaagtcatcaaagagacattacatggagccatggatttagattattttttgtgtcaggtaaagtttgaaaagataaaatcactgtttgttttttaggacagattttctgcaagtccattgtcatactacagtcataacctaaatcacatttgaatgaaactttgaaatgaatgaaactggaaacctcttgtacttaggtagttgtggctacagtgaataaaaatgacatgctttgcagttatgtaaagtgtagaaagactcaagatcgaatgccaattaataaagccaagtcacctgcacagcttcattttattattttttaatctcataaattattttctcttggcatctccatcctagaagctctatggaataggggaagggagcaggaacttgcaagtgtatcgggacggagtgagaaagagaaaagtagatgcaaccagagtaaggaggctggatgtacagccagtccagaaggtgctatggtgagctggttcacagagtcatttggggctttaccctagcccacatgcataggcaaacataaaaacatatgcattcacaatgtcattattttcaatttagttaacagcttttcaaatcaacatggtgtttcatagcaattaactgtaattacaaatccaagaaacattttttttttctgggtaattactttcctgattcttgttccatcattttcatttaattctgaaaaaaatttaactgccattttgacaagtgtttagtgtttttaaactgattgtgtataccctattacataagtactttatgcatacatttctacacacttttccccaatccaaaaatgtctataaatgtttgcagcgactccctatctggaggctggttgcacacttactctcatgcctatgattgcttggaagggactgtcaccactgccaaggaagaacgtttttgacaatagaactgccaattaatcagtggcagacgagagaagaattggctccatattttctgatggcgactggccacttggcagccagccaccaagtgagttattgatccattggaactcagcctacttggattgccatgatggggtttctgtcagcaggttattacaaccgtgcgccttgaggagatgaaaaaaatttaaaaagacaaacttaacaggtttaaactatctaaagtgaactatatgataggcattggcaagctgaatggcagaaatactgaccccttggatttagatgtattgaatgagtctctgaaattcaattaactggcccagatagcaactgaaatgctgtttgtggtgaggagggagaagattaaacagtactgatacttgcaatgagttcttaattagaagggcagaataaacggagggacaccaaagagataggatcaagctccagttcagatgcttatgagctgtgtgacttctgtttgtataattctttttgttttgttttttgagacagagtctccctctgtcacccaggctgtagtgcagaggcgcaatctcggctcactgcaacctccgcctcctgggttcaagcgattctcctgtctcagcctcccaagtagctgggattacagacaagcaccagcacgtccagctaatttttgtatttttagtagagacagggtttcaccatatgggccaggctagtctcgaactcctgacctcaagagatccacccatctcggcctcccaaagtgctgggattacaggcgtgagacaccacatccagcctctttgtacatgttttttagcgggataaattatatcatgtgtgtcaaagcatctaggactgtacttgacactgagttggttctctgaaatgtcatttctcttttttcctataaatcttagggttgtgttattttataaagaaccgagttttgaggatcatttcattctcagaaaatttatttttatgtattcatgatggcataggaatgactaattattaacctgtagacctatgtcttttttatgaacttttaaaacctttctaccattgtgctataatataagcattttaacctattatttatcttaccaggtgctaagataatgaccaggtgctgtaattattttattttaaaattatcaattattttattttcaatgatttaaaattgtgatgtgaaaggaatactagaattggaatacaattgcactggccaataaatgcagatttttctagaatatgttcagctattgtgtaaaaatgatgtatgaaagctacattttccttttttttttttttttttttgacagagttttgctcttgtctcccaggctagagtgcaatagtgtgatctcagctcactgcagcctccgcctcccaggttcaagtgattctcctgccccagcctcccgagtagcagggattacaggtgcccgtcaccatgcctggctaatttttgtttttatttttagtagagacagggtttcgccgtgttggccaggctggtctcgaactcctgacctcaggtgatccacccgccttggactcccaaagtgctgggattacaggcgtgagccaccgtccctggctgaaagttatattttccttataggtttttatccctttgttctattctcttggaagacgttgatatttgctctcctaatttctaccgtggcaaggcaaagaacaatgaattacctctaatggtgctactgacagtgacaactgatggctgcttgtctgtattggtgtgaatgataagcctggtaagctcacagccattctatcacacacaactcacctcagcctagatggctgatttctccatggctcagcttctttcatttattttattttatttttcttttcttttctttttttttttttttttgagatagagttttgctgttgttgcccaggctggagtgcaatggcatgatctcggctcactgcaacctccacctcccgggttcaagcgattctcctgcctcagcctcccgaatagctgggattacgggcatgtgccaccatgcccagttaattttgtattttttttttttttaagtagagatggggtttctccatgttggtcaggctggtctcgaactcccgacctcaggtgatctgcccacctcggcctcccagagtgctgggattacaggcatgagccatcaccccaggcctcttttctttctttctttccttccttccttccttccttccttccttccttccttccttccttccttccttcctttctttctttctttctttctttttaaaagagatggactctcactctgttgcccaggctggtgtgcagtggctcaatcatagctcactgcagctgccaactcctgggtgtaagtcattctcccgcctcagcctccagagaagctgggactacaggcacgcagcaccatgcctagctaattaaatttttttttttgtttacaggttgggtttcactatgttgcccaggctggtctcaaactcctggactcaagtgatcttcctgcctccctcccaagtcactgggattgcagttgcaagtcatcatgtttggctcgtgtattctttgggaacacctatgagcccagcattaaggggctacactcattgtgacaaataattcattcagaaagtatttattgagtctatttactggaccagagactctgctaggtgacaggaccatggagatacccctaagacatagctccaaccatagggtgctgatagtctaacaagggagctaagacctgtctgtagataactctaaaacaaaataacccaagtgtcacaaggaagaaaaaaattgctcttggagttgagagaaggaaggaagttggggaaattcaggaaaggcttgactctttttttcattcattcaacatacacaggaaaatgagactatactaggctggtaatacaaagacaaaacactatttgatctcaaggagtttatcctctagggaaggcagatactcagactagtaacagcatcctgggataaggttaagtgttatggacaactgaggtaagaacaaagtgatgtgggagcctggggattgctctctttaaggaaaacaaggaaggagtcatggtctaagcactcattgaactgggttttcttcagtgagcatatagtctagtgaatgtgactgccacgcccatgaataattccaataccaggtagaaaatgccgagtgccctacaagaaactcagacatagggctataaagtaggttcagaggtgagtgtgtttacttctagctggggtctcagataaggatttaccaaatagatcagattggaggtgagctttaaaagctaagcagaagttcaacagggaaaggagtgagggatgtggtaaaacagaagaaatagcttgaataggccgggcgcggtggctcacgcttgtaatcccagcactttgggaggccgaggcgggtggatcacctgaggacaggagttcaagactagccttaccaacatggagaaaccctgtctctactaaaaatacaacgattagctgggcatggtggcatgcgcctgtaatcccagctacttgggaagctgaggcaggagaatcacttgaacccgggaggcagaggttgcagtgagcaacctatatataatatatatatatctggtcctcaacagctaaaaatggcctagccagaatgttggcagccaaggcaagttgggcaaccaatacaatgtcatgtccgagctagagagtttcaaagagctcctccatgtatgatataaatcacatcaggagagcttgcaaacagtaaggttcacctgtggttaaacttaaggctgttcataaagtctagcaataaaactatttctttcccatgtaccaggtgtcttagttttcacactcccaccacaacttgaaatgtttaatatgaaagtgtgactatctgcaagtaacactaaaatattgtcccaggaggcttgttcacaagaaataggcacagcctgggaacaatgatctgcaaagctctggaacctgcttttgtttgcatttaccctccttgtagttttggacacactcaagtacagctgcatttagcagctggtccatgatttggtctattctcattgtgtcccaaactgcagactctgcagatgaatgtcagtgtaaacatgactctttctgatgggttgccctaacctttggttcatttaatctggtacttggtcatcactaagcacaaaggctgctgttacaagacagagacatcttagtgagtactggaaacacccacaaatcttccctctcaaatgagctttagcacgtgagctctgaggtccctttgcagattcacaagcagctggaagtttctgagacactgaacaattaaaatggacctcttcttgagaactctgtggcttacactgtcgaagctctaagcaaacgttgttttgtaggttcaaaagttggaactcatactgaattggaaaaattattgtatgtcttaatcagaaaaggatttagggtagctagtagcaggcattctgccaggagtctcacagccctccaaggtttaagccttaagtatcttcttcccaatttatgtgtcgtgcatcataaaatgggtctaagataacaacatgtttagataaacattaattaaacctttagctaaaaaaattgtttgcctccttagaatatttgttggagaggggatgttttggatgggtcctgtttgtttgaaaagactactcaagggagtttcccaaaataaatgtccttgtggcagagactcaaaatcattcatagaatagaactggaaatgtagaaatgagagagcccaaattcagaggtgttaggttcagcaaacagagcatgacgtttggttcgagcccacctgtaggaccttgagtaagccaatgtttacactcagtttctgcatctgaaaaaatatggcaaagaagatgtgcttacatcacagaattgtggtgagggaggattaactaaaatactatactttgggaaatagtttgtaaatttcaaagtgccattaaaatgtaatgaattactattataatcatcactgtctgaggtcctacagcttatagcgacctcgtcagtttttcgaaaagagagagagagagagagagagagagagagagagcactcttatctttccccactagatggcaggcgagccacttggtaaagtactgattggcttaggactctagaaaccacagcaggattttggtttgtgaagcagcgtagcaatggacaaagggtgaattagaagtcatgaaaagcagagacagcctgtatcccatcggtttgcagtttaccagcatttcgtgtgtatgaaaacatggtctttttcttttgactgtgagaaaaatgatagctaaacaaataatttatctaagaaggaaaatgttgagcccactcaattacagctaacagacttaacgattatttgtaacaccactttataggtaatgtcttcatctatatcagggattgacaaactgcttctgtaacagtaaatatttctggctgtgagggttaaatggtttatgttgaaactattcagctttgccactagcagaaaagcagcttgagacaatatgaaaataagtgggcatgaataggttactataaacgtttatttatggacaccgaattttgaaattcacataacttacacttgtcacaaaatattcttcttttgatattttttgagcactaaaaaatgtaaacattatttttaggtgaaagattgtacaaaaaatgaccataggcgtgatttgactggcaagcagtagtttgcagatccctgggctaatgttaaagacttcttagctatcagattagcagtctccttaatctatatatttataactctcataacacatatttcaatgtggttagtatattttttgcatgtataaattactaaaaatccatgtgatatttttgcctacatctgttattgtcttgtttgttaaagactatagacaaaaaaattcaagtagtaggccaggcgcggtggctcacgcctgtaatcccagcattttgggaggccaaggcgggcagatcacctgaggtcaggagttcaaaaccagcctggccaacatggtgaaaccccgtctctattaaaacaaaaaaatacaaatattagccaggcatagtggcgggtgcctgtaatctcagctacttaggaggctgaggcaggagaatcgcttgaacccaggaggcagaggttgcagtgagccgagattgtgccactgcactccagcctgggtgacagagggagactctgtctcaaaaaaaaaaaaaaaaaaaattctagtagttggtgcattgttcttgggtttgtcagaaagaaagcacacagttaaatgtgaatttcagttaaaaaactaaaaacaaaagggattcactgctttctctgagactcaattttaactgggtgaactaaattgctaagtctgatatttgttcttgtactgaccgatcctcatttattaaggccttaataaatgaagttgaatatctgaagacaagacttctccagtaaaatatgtctttggggaattgggagaaatatggatcttcactggcctggttgttttccgtgcactttaacgcattaaaacaactgtatggcattaacagctgtttttcacatccattttctagaagaacaaattctgagctgccagtctcagttgaacaagccatttaaaatgctttgtaagaatctcagagtaacctgtggacaagcacttgccattttatgttgcgaagggcttcagagaaatttgaggtcttataaaggaattgagtaggaacagcaaataaaatcctcccaggctggcgttctgtgaaactgagcttccttcaggccgtttcacaacagaaactcggtcctcctctgaaagcttttttataccccttgatggaggtgtcaagcgtgcacaggcagcaattcgtagggcctgctttagagaggtttctttttgtgtgtatctgttaggattcactactggtattaaatattaacccacatttaatttgcctcgtgacttttcacgacagatattgaatgttaaatactctccaaatcggatgttttttccagttttaagatttgacgcccttatgatcgaatccatccacgacttttacagttattgaataaccaacagacccttggagggtctcttaccgctctggacttgagttggttaattccgctgcagagacggagtggggcgggggcgggggtgggggtgggggtgggggtgagtggtgtaactgaggaagagtccctggcatactgcaactaggtcagaagtgacagcattcagccctcccctccttagggagtggggtaagggggcgaccccgcccagtgcagagggtggcgagtcaggagccgacgaatgctggagaggccatccgcaggggcgggtctctccagagagcagccgggtgacaacgtggcacagaacggcactgcatcggagtaggcacactgcaaagacgagacgagtcctccccagagaggggaggcggttaaggagaggagattgcgtggctcggagcagccagacccggtaagccgactccttcccgtattccgctttaaccaagcttgtttccctggcggccccacaaattccctgagcggagcgtcttcgctggctcgcagccagccagtcagagcccacctctgcgacctcctcctccttcccatcctgagggctcctgcctcggctcccggcttcctcctccgggctatcttttaccccttcggtagctggaaaatcgccctcactcaatcaccacggtggtaaatagggcaaaacgagcaaggcactcgcctcgggtgcaaaatttaaggcggcaccaagatactcagtaatcaagataaaactgttcatgcagtctctttaaaattcaaagttatagccaaaattccgcaagaagctagataagaaatattaaataagggcaagctcagaccttgcacttgaacgacttagcctcacttgcctcacccgaatccccgacgcagctaatcaactctgaagtgattccctcctctccgtggtgccacgtagtagacctccggttttcgttgtgtatacgccttcctggttgtgtgggaaggggcagggactgagcctcaagtagcgcagcccagtgctttgttcaccgaggccctggggtcaacgtggattttggagtagcccaaagctgagagcttatgcagccgccccaagttgcaaagctttgcattggaaccgcccgatccccacagaagcaaagttcgaggggaaactgcactcccttaattagtatttaggaaccccttcaataattgaattgagtataaaatctttaaagtaactacaaatagcagggaacggcttttggaattgtttttctagaagagggacgcctctatgcttagagattccttgttcctctctagcttcccatgtgtatttggtggtatggcagttcagtctgaagttgcaatgatacaagcacctttaatgaggatcacactcaataacttaggaagcaccatttacctctcctagtaagtgactagacactgttaggtgctggctaaaaggggttttcaattcttacccctagagccatttaatgctgatcttgaattgtttgctgctattaccgttaagggaggcgacaaggggggcaagtagctccggagtaggggatggactggttttatttataaatgcttctttttgtcttatgcgggccagtgaaaaatgaggtaagaggaagatctgtaaaagatctggagaagatcaggaaacgattgttcaaatccgtgtgccttttcttaaaatcttttgaggttttgggcttgaccagctcttcaaaaggaagaaaagggcacatgtgatccctggcctgctaaacagagtttgcttcccttgaggaggtatcaagccaaattctacttaacctggaatggggaaaaggtgggcagaacggtcattgtcggcatcgccaaacgggggtcacggcagatccccttagctgttggatttcttataggcctggtttagctgttccacgctgtagccagcagagggcactgttgctacatagaatcttttttgactgtttttggtggtgaattttcagagctatttaaaaaacttccatccagtaagaagtatgaacgattttccatgaaattttaatgtgaaaaatagattattattaaaaactgatggatgtctatttggttgttaacccattgaaccatagaaagagagtgaagatgttccataacaatcaaagattaaaatagcaagaacaaaaaataaatgtgataataaatatcagcatcatatccctcaattgtttcgaacataagtagttagggcttttgctcatagggatgatacttaaattttcaaatgaagaaagttgatttgtgaatttatattactcatttggaagaatgaaaactgggatatgcatggtcatgtgatcttataatgtacaattcagttttctacatagaagtctccagtaaaatatgcttctacgtgcagtgggaatttaaaaattaacaatgtaaaagatgtataattaattatcataaatgaaataacaaagaaagaatgtgtatgattctgagtaggattagaattgaaatctgttcgttatgtttaggtaatatttgtagaaatttaatggaagagttgtatcgatactaatttatttcttaccgttttgataggaatatgtggaacaaaaagaaaattcatattgtagaaacttagactcacattttgtgttagaacctatgagctactctgggtgttttattttaagatggtttttgctcattgttatgctacaggtattatcatacatcttttctaaaggtggaggccttcttttttatttaaccagaagtttcttgtgttaggatgattttgagcagttaagaattgcaagaaaaaatcttaacatcattagtttcaagtgcattgtaatggatgagtgtgtcatctagagcaagattgcatagctgtacattttgggctttcctgcttaataaatgtgtgacctcagacagattatgtaacttgtctgagcttcaatttcctcatctataaaataataataataatgcctaacacatagggttgtattaaatattaagtgagttaatatatgtaaagcagctagaacagtgcctggcccagaaaaattcactttattagtgttatttacctattatttttttccatttttgttaataatatttgaacatgatgcattaatttccccttagtttattgtttagctctagagctgcttagattcatttgcatataatattgcttatttaattttaaagaagtggttctatgcacatttagtaacttacgcctcttaaacattggctatgcaagagaattcttgaataatttcatgaagcactctttgtctcttactcagagtagaatattttgaagacatcttttctctgaagtttttagacaagctataaactagtttgtattagtcagagttctccagtgagacagaaccaatgggatagctagctagatagatagatagaggagaggggatttattagagaaatttgttcatgtggttatggaggatgagaaggccaagactgagggactgacaattggcaagggctttcttgctgtgtcatcccatggcaaaggagagagaggccaaacttgcccttttgtaaggaatccattcccatgaaatgccattcccatgaatggcattaatctattcatgacggtggagcctaaccacctcttaaagatctcacctcttaatactgttacagtggcaattacgtttcaacatgagttttggaggagacagacattcaaaccataacgcagctccatgacagaattttcacatgctccagaatgtgaatgacagctactcattttaagggaaaacagcttagtttagtgtaaaaaacatggatattggagtctggagcttggacgctagctgtgtgactttggacatgccacatgtcatctttgagcttctgctttttcaaatacaaggatgttgtaaggccaaaatatgatcaggttgtaaagggtttgccacatactgagtgctcacatcaaaacatattagttccatttccttgaccttactccctttctcctttgataatgcttcattcaagggtagatcgaagacctcaggaccaaggaggaaatgaaatgttaagaagatttgactgtaacaaaagggttagtgttaacacatccattctgtacctatacaatagaagtgcaatagtaatcttagaagctgtgaaagagcactgctgcttcctctctctgggcctctgaattaatcaatgatgtaatatatataacacatataatatatatactatattatatatttattatatatactatattatatatttattatatataaatatatatttatcacataataaatatatatactatataatatatttattatatataataaatctataataaatatacatactatataatatatttattatataataaatatatatttaattaaatatataattaaatatataacatatttatcatatataataaaatatattatatatatttgtatatgtatagattagtgtataagtatatatatttgtatatattatatatatatttgtactaatatacatacacaaatacatattagtataggacctagttactgcctctaaggcttcatgtctttctgatggtcatataatggaatgaatgggacttgagttggatgatgagattccatagatagaaaggaaagagggagcattccaactagaaggaatggtgtgaggagaggtacaaatgtgattttggtcaggagccaataagtaaactagtctttccagagaacctttcttggggaaggtgccttgtagtgcccacaaatgcaggaagcaagaattaggacaaggtcaccgatggtcagttcagaaggcttattgagtaagcacaacacagcagaggtactgtttggggaataaaaagctggtggctatgagggtggacttggttatggcaaagttagtcaggaaactattttaacagtctggggccagatcatggagggcctcataggccccaattgctccttcatctacatttgcttcagcttttacatctttctagaccagtcctgttgttttacagctgtcttccatttcagtcttagattctgtcttctatttgcaagtggcaattctaaaatcccatttgatttccatagcatctaataaaattcggttttttctccaccccaccccccccatgaaagcaaattttccatacattttgtatgccaaaacctagtaacaaggaagaataggtcagattaatcctaaatatctgctgttttattcactgcaaacataaaccctttcgttaatatcaagacagctaaacaactccacctcatctaagaaatctggcatctgaagccctttatgatttgcctcaacaaatcttttacagttttatttttactgcccacttcagccgtcctttgtttcagcttcatccctcatctaattccacgcgtacccagcaatttcgtgcctccgcctttgtcccttccacctgcttgccttctcctccacaccctaaaaattctacccattcttcaaggtcccattcaaatgctactccttttgagagcattgcatgctggtcttactttctgtactataaacatttatgctataaaatgaggacctattctattccagttaccgtcaaggcattcccaaatgattaaaacacagggaaacagatggcactatagtgaaatatcctaagtgctgtaatcagagtaggcattggaggaaggctctgagagtttccatcatcaattcaaagccagcaggagggatcagggaaagcttcctggaagaggtggcatcagaggcgtttgaaccagagtgactccatcttgagtaggggctgggtaaaataaggctgagacctactgggctgcattcccaggaggttaaggcattcttaatcacaggatgagataggaggtcagcacaagatacaggtcacaaagaccttgctgataaaacagcatgtggtaaagaagccggccagaactcaccaaaaccaatatggcgatgaaagtgacctctggtcgtcctcactgctcattgtatgctaattataatgcccaccaagcacctggatttaaaaattggtaactatttagccaggtgtggtggctcacgcctataatcacagctacttcggaggctgaggcagttgcagtgagccaagatcacgccactgcactccagcctgggcgacagagtgagactccatctcaaaacaacaacataaaaattgttaacatttttccataaaataaattactgataacattgtatatctatttgcttcagttcctccctcgacaaaacatatatttatttatgttaccacagttccattactgcacccaatagaatcaacagcagtggccgaatgtcatctaacagcctactcatgctccgattccctcagttcttccaaaactatgagtgactatttatttattaattattagtgaagcgttatcagaagatctgagatccgagaacttggtactgttgttcacttgatatgagtcgtagtatggattggtagacgaacaaaacttaagacaacaaaatagatagtaattatttatttgaaaacattttcctctcaaagctacactaacccaaagaaactgcgggatcaactaagatcagcttgaggactcaacctggttacccaggagttatggcactaccagaaactctcaggctctagagagaaaaaagactactgggagagaactccagacacttgtggatggatagtcagatgtttattccaacaccattttttgagtagtccatcctttccttaatgttcggaaatactaccagacaactgtaaaaatattaaaaatgaataagtgaacatatttgtattatcttattgggggaaagacttttcaaagcaaggcagaaacagttgactacataaatacttgaagcaactttatggcaaaagacaaaagcaataaaattcgaaagtaaatgacatgctcggaaaaaatatttgcaatatagagaggattaaaaataagttctctaaaatgttaacagtacctataaatcagtaagaaaaaaatataacgtggaaaaaggataagaacaagtatttaaagaggaaaggtgatgaaagaaatcaattaaaacaaaaattagataccttgtgatttaccttctaattgatacaagtcacaaatgttgattatgtgtcatgttggtaagtacatgagaggaaagaactgtcatttgcttttagcatacaaattggtacaacctttgcaagggcaatttggcatatatacacacacacacacacacacacacacacacacatacatatatgtgtgtgtgtgtatatatatatatatatatattttttttttttgagacggaatcttactctgtcacccaggctggagtgcagtggtgtgatctcggctcactgcaacctctgccccctgggttcaagtgattctcctgcctcagcctcccaagtagctgggattataggcatgtgccaccatgcccagctaatttttttgcatttttagtagagacggggtttcgccacattggccaggctggtctcaaactcctgacctcgtgatccccctgcctcagccacccaaagtgccgggattacaggcgtgagccaccatgcccggccctggcatatatttttattactccaaatttataagctactcatttagattgcctctgttcctgacctcatttcctatttttatgtttgctttttcctagatggtgtgcttctcacctcagcgtgatagcctgaccttgactcctgagttccacgatcgcttcacaactgcaagtcaccatcatacaaaatttgagtttccctaagtccgcgcctttgagagctttggaacgatatgcaagttcaagtcaccatcctgtttcttgctacctcctgtgagaagaccaacatttgggttacacttgtttctactcttgttcttctgcttgttattgttgcctctgcagccattgatcacacacgtgttgtcatacaaaaactggttagcctttttatttgtcttgtgaattttatcatttggttcttaagtattacaaattaatattgtgtactctcattgatatacaacttgcagtcattgtaaatatgcgtgagttaggggtgagaatggcatgcaagcaaaagaacaaggagagggatgatagagatgcaagaagagtaaagagggcaagaaagtttatgttaatagcgaacacaatgaaagttctttaaatgcttgataatggtgaaagcaacacttcctagggcatatttttggtgttaatgaacctacacatcatacaataaagaaaattgag

SEQ ID NO: 11 - DNA, 141086 bp, Homo sapiens
caggcccagaactgcctcactaagctatacaagctagataagatgcagttccgacaaaccatgagggactatgtgaacaaggactctctcaataatgtagtggacttcttgcatgctttgctaggattttgtatggagccggtcactgacagtaagtaaagctgcacccaagttctaggagaagtcgttgtgaggtgaatcaggtagtgtttcaaggggacactaaatttgtggaggtagaatttagaggaaaagatacgtatgtgtccatgcatgtgtgtgggtgtgtgtatagagtataaacaagaaaagcttgcacattatctctgatgacacattttggaggctttctgaggacaacttaccacagtaaatgaaagtttggtaaagcttgtggagttctcacctagcccttcaatttttatactaccacttatgggactcctctctctcatataacattctgttatatgacctctgaggcagtgatcatgttcattagttcaacggatgtgaaatgagtatctataacgtacaggcattatagtggcacagtgcctgacaattttttcacaaagtaaaatgggagaaaaaaccttacgattgcagtaaacatagtagtaacacaattttgacacacacatacttaattttttttaaaaaggcaaatggatgcacagataaacctacaagctattttataacttaatggctttcagaaaactctagtatgaaggcctaagttacagggggagaccaataagtgttaactgcatttatagtaaaccaaagactggcagtccagtgtgaatgcaaatgcagcaatgcaaggaaaataatgcatgaagcctgagttgaataaaatacacattttaattagagtctgggaaggatagctttgtagtataggcttttattgtttatataacaaatgtatgatcacagttgattagtttataatgaaaatatatttgctagatttagaagcagttttcctggttgtaacccaggaatattgtttggtttcacattaaaataaaatattgctcctctatagaacccctcaaacaatctattagcagagttgttttaaaccaaacacaatataaattaaaaagacaataaattaggatggcagttgagacaatgctagagaaattcttgattgcaaatgatttttttctcctttttaaactatttgagatagaaattataagcatagactaacagaaatctttcatcaatgtgaaatctagagatcatcccctgtcaattggcatagacagtgagaggttggtaataaagtatattactttaaggtgataaattcctcctgcgttgcttgagatgtgggagtggatcacagtgaatcagccaggcagacataggtccccatctggtgaatattggagctgcccatgccctttgtcacatttcacaggtagttcacaggccatgagaaatcctctggcacgggcacaggatacctatgaaagatccagttttctgtgaaaaactggcataaaatgccacggaggtcgaaggcttccattcacgggcatttcacatgtgtgtgagcaagaaggaggtggctctgaggaagaggggaggtttcccctctccacctgcccaagaaatttctgggagaactctgcagttcttggcaggactctgtctttcccagggcctttgagagcttccctgcagggctcctgcctgactctttcttctcccttcccagctacctggttggccccaccttattccactttagacagactgaacaatttcctttgagaaagtagcatttctcaccaccagaaagcttgaaaatgaattctccattgaggggttatttaggagctttttttttttctttttttttctgtaagtgatcacctatttaaaaactactctaagcctaaaaatctttcctaaacttaagagttggtttcctttcctttgctaagatttatcaataaaaccattccggaaatgcaattggttttatcacagtaaaggctctgaaggagactatgactcattcatttccacatctgcctagagattattaaacctggggcatctttaattccttgtttctgtatttcacatagcacttcactaattcctgggtgccaagtactgccttactcctacccattgtgtagcttaaaggaaacattgtctttaatttgtgcctttgcattccagacaaggctgggtttggaaataacttcaccacagtggacaacaaatccacagcccaaaatgtggaaggcattatcgtcagcgccatgtttaaatccctcatcacacgctgcgcttcaaccacacatgaattgcacagccctgagaatctggtgagaagctctcctctcttcccacaggagctctcagtctctgccctgagaaaagtactcattgtcgtggccatgagtaagagaagctgaaatctaaaagtctacactttaaagtttaaatatctattttccccggtgtcaccagtaagtcataatggagccttaacaacacttttcttctccttgttactcattatcctatttgcaaattcagctatcttcctctcccatctcaaaggttatagagtgtttggtgaaataattgtaaagtatgctgagcccttcagaaagtttctagagcacagcttgttggctcgtaaaatactaaagaatgttatcccaagtattatttgaagccatatttactttaaaaattaatgcaaatatgttgctgaaattggttttgttttcttttattaagtactgtctgtaatcttttagctacttgtcttgaaagactgttaattaaaccactgaagtcacaataggatagggaagaaccaggttataaaaggctagtgctaaaggcattaagaatgacacagtagactttgaggactcagggggagggtggaaaggagttgagggataaaagaccacaaatcgagttcagtgtatactgcttgggggatgggtgcactaaaatctcacaaattaccgctaacgaacttactcatgtaaccaaatatcatctgttccccaaaacctatagaaataaaaaaattaaaaggctagtgcttaattaccaccaagaagattgtggttttggatacgaaaatgtagattaaggctgaaaaatctaacatgaataggtgaattcaggtatctttgggaggcaaagaagcatttctctatcctaccagtctgttagatattatgactcctatgcggaaatcattccatttgcacatgtggaccctatcagctaatgtactcaaatcaaggaaattattttaagctattataactattgaaacaattcacttaacttgagataaaatcccaaactaaaggagttgaactttgctgacagccaaagccaacccagcaattttcttggagcttgagtgtagcacaggtaccatccatgcatacaatttggtcatagcaaaagtaatttaacaggttggttataatatacacgactgcttatacatctttttttacaaactcatgtatagaaaaatactatattaaaaaagaaatcttgagtttgactttgaactcccatcccataagaacagtgggacatcaaacttctgtcatttttggggttccccacttcacagtgttgtgtaaagacccccaagtcttaggaagcatctagagcctggggaggttccacaggtctcaatgattagcctacacctctgatttcacatagtactctttgctgtgtgcttagggctgggcactctctggtgagtttggaatctttcctttttggagtcttgccccattcctagaggaactactgcagagcagagtgaggggcacagcgccctgcttcccacagaacccaaagcgttctccatccgtgttttctccaagggtcctaccttctactttcctaaaaattatggacataattgtcccagtggtctcaggttttgaaaaccaaaactatgaaggtaagtgttctttaggcttctgcattctgccttgccatgaacttttcctaaggcaaaaaaaaaaaaaaaaaaaatacagtaactaccttcttcatgagcagagagagaggggaaatgctggatccaaagcttaatttctcaagtaaaagtccagcatatatttttaaatattgattcaccaatatattggttttaatagccctacgtcaccttcagtttgtagtcgagttcatgttcaaatgggctacaacatatatgtactttgctaaatctgtccagcaaaacacatcatcctttgaataatctgtctttggtagaagtgtctggaggacttaacatattttgtcataatgttgcagaaaatttggagaagctgaacagggaccaaaatctctaatgtaaacaaatttttgactacctttttctttgcaggcatctcttcagaagttacaattaaaagagaaaattaaagcttgggcatccaatagtttaaaatgtaaattaatgtctttctaatgatgcagccaactttctgaatgaagcacgataaccatccttttttataccaaggatgaccagcaaaggccttggtaatgttcttctataggaacattgtagagggagtataccaccagtttcatcaatagtaaactgtcctgtcttaatgattccaatgctcatctaagcctaaggaattactttcttcctctctacctggaaaaactatttaatcacacagctatctttctttctccaacttccttcttgcctccaaacagggactgtattgtgacattcgtcagctggtccagtttatcaaagaggctcatgggaatgtcttcaggagagtggccctcagcgctctgcttgacagtgccgagaagttagcaccagggaaaaaggtggaggagaatgaacaggaatctaagcctgcaggcagtaaaaggttggaagcttgaactctctgaatattactgtttgccttaagtcagtagaataaaatctgttgtactgtttgtgtggttcctgtgctgaaatgtcagcataggaatggtaaaattatcttgcgtaagtggtttcactggtgtggtgtagctgcagcttagaaaatgaatgaatttactgtcaaataaatgctgcctctaatatgaattagagctcagttgttcttaaattttcttgtacttgaactacacgtcatagctcttaattaaatggtaaaacgctacctgttttagtctcttctgtacataatttacacttttattcagaaaggcaaagcaattactgatgccatatgatcctgttcagtaaattctactctaaatgtggtaaaagacaaatgattaagtaatagcctgttgtttttccttctagtaaacatatatttattttatgcctattgtatattaaatgccacttaaaaattaaaataaactcctaaacttaaaatcctgcttgcagttaatgactctgtttgcaataatggtgatattgtgaagcaaaaaggctgctaagtcatgagttaatggtgcggtataaattctaaacaacatagactcctggtgacataaagttcacaagctgcaaagttgtctacaacagagtgttttgttttatgaagtgtatgaagtattaagacttgctatcctgctctgctgtaattgttggaatgcaccatttgcataggtcagaggcgggaagcattgtggataaaggccaggtatcctctgcacctgaggaatgtcgcagcttcatgtctggtcgcccctcacagactccagagcagtaagtagcgttggttttgtctccagtgcagacggctatgcacttcactctggaagaatttctattttccaaactgctatttgtttgtttttcatctcctttgaattttgccttgtttctaccctttacatttcattcccaatgccactaactctccaggccaaatcacaaataaccagtctgtgcctatgagaagcctccctaactacatttcccatctccagtctctccctcacttctgcttttcatgcacactactgaagatacaccttgaaaaatggcatatataccaggtgggctgggagtgtcctccagtttcttgcttaaaatcacttataattttttaaaaacttaaatgtatgaatggctgtcaatatacttaatgaagcttttcccaaaataagtatcaaaaacttctccagttctcacctttagctgaaacatagactgtaccacattgtaccttggtcctctcttgagatccattccagtgtcctccgacatcagttaatctacacttttcataatggaaaaatcaaaaacatctttaaattagtgcccccagaaaatataagggttatcatagacactaattgtacagcctagttctatgcaagttttatttgtattttttctctttttgagaactactaatccacaagtggagtgtaaacatgtacttcgttttaggtataccattctgcttccccaaaccttactcagtattaagtgatttttcttccaggaatcctgcagaatattctaggtattatggtatcctttcttcacagtcagggaaatcaaagtgagaagcacacagctatcagataggaccttggtaattcatagcaagcgaacaaaatcttcaaagaaaaaatgcccacagagttcttgtagcacttcaaaatcttagaaattttgtagtaaacacaaatttgtgataaacacaattttgtgtttatttagtgttcaagtagatcaattccatgggctcagggaacatgtgagtttttgcatatggctatagccccagtatggagactaggcttgctcatactaggcacttaatctatatttcatgaatgaatgaatgattcaatcaatcaatgaaaggataaaagtgtcagattattattaagcttttgttttctttagcttcctttcttaaaattcagttttagttttccctttaaggtagtctttaagtacatttaagtaaaaattcaaacataagctctaaggaaaaataatcaacgtgaaagacaaagttctgtgactagccatgagactagttaaaaggctttatactcagaaagtctgcccaaaaaagaagagattttttttttcttttcaaataacaccagcaactattgagctaatctgatcaatgagaatgatcgaatagccaaattggacttaaaaaataaagccattcactgtatatttctaggttattaagttttctaaattccaaaatattctttttgttcagtgttctgtaaacaccacctaatttcttagcatttagcacatctattctttcttcttatgtgaagatacatgtttcaatatgcctctacataaatatttccacttagagagatgtcataaaatgtcaaacatggaactttttcatgatcccaataggcctagaaggtaagcatgtcaaatgtcccctagttagcactggagaaagatgggtggttacttcagatgacactggctcctcctctagcttctctgtctctttccttccctccccttctggccctgtgtcctcttccttcttaaataatagtcacattcactgagtcatattaaagcagttttatgcactaatttctttgaaactcaatattgatacacaccattggacaaagccgatgtaacattttattgaggaaattgagaaattatagcctccccagatgtttttccagccagactacatagtcatacacgtatcatgccatgcatttaccaaaagtgagaaatgcttcataccctgtaatcatttggtaaaaagtaactgagaaatcaaattttagaaaactgatttaaattcataccatatttggtaaacagaataccctattttttaaaaaaagaacttaaaaatattcagtactctgatgagattttaagaaattctggatacccatataaatatctgtagaaaataattgctttacacagtactgtcaaattttgggttgattcagccccaaaacttgtaagcaaatcaatagctaaaaccccataaataagtttcatcaaatattatgtattttctctaccttgtactttccaaattactgcagtaatatatgttgctcaagctgacaaatgtagaaaacacagaaaaacataaagggaaagtagtttaaaaatggaaataccaccaactagagataacctctgtaaactcttggtgtattatgttggagacatttttgagcatgtgtgcacacaaaaccacactcagacatgtggccacatgtgtacttttttcccccaattaacctggtgatgttctttttaaaccatttgattgttaccttttcactttgcagtatatagtgaatatttttcatataatagtcctctaaaataaaattataatgactacagagtataccaccatatggaaatcccataatctattcaactgtttccgtggtgttgaacatttagattgtttcctcctttttaaagttgaccaataaaaactcagtgagtttttgaccttcttgtacctacatcttttttttttttttttgagacggagtctcgctctttcgcccaggccagagtgcagtggcgctatctcggctcactgcaagctcctcctcctgggttcacaccattctcctgcctcagcctcctgagtagctgggactacaggcgcccgccaccgcaccctgctaattttttgtatttttagtagagacggggtttcgccgtgttagccagaatggtctcgatctcctgacctcatgatccgcctgcctcggcctcccaaagtgctgggattacaggtgtgagccactgcgcccggccttgtacctacatcttagtacgttgtcccataatttccatgagattactttctggaaattgaatttctctgtcaagggcggtgatataagctttggatatcgtattgccacattactttaaagagaggttggatcattttacctccccactgggagtataatagtaaccattgttttctctcctccccaccccccaccccgcacccctcatgaactcccttaatcactgctaatttattgagtaaaaataaagatcttacttcagctgcctatgttttttaatttctggtgagattaaattctgcatattattggccactggtctttttcctgttgtggaatgccctactcaaaaatccccttgcaggtatttctatttgtcctactgagttgtacttattttttacttgcaagccctacctaagtttctttgacttactggttgtaggataatgcatttcccgggtgtggtgtgatggcattccatgcatttaaatatttttttaagagtatttggtgttcaagtatgatactatactggggtgatgcgtggggaatgaggaacagtgctgcacaagccttagggatctttaataaaaagttaaatattggctgggcacggtggctcatgcctgtaatcccagcactttggcaggctgaggcagacggatcacgaggtcaggagattgagaccatcctggctaacacggtgaaaccccatctctactaaaaatacaaaaaattagccgggtgtggtggcatacgcctgtagtcccagctactccggaggctgaggcaggagaatcacttgaacctgggaggcggaggttgcagtgaaattgtaagtgcttctggtattatgactcacacctgcagatgaatacctgcaataatatttaatgtttttattaaagttgaaaaaacctgaccacctcatgtcatagcagagacatgactattttcaagaagagctcagaagatgaaccttgatctctttcctcccacttcaatgcccactcttcccacatttcagcccatcaaagatcattttgcatgatttgcctaaatatcattgacaggaagatgaaagaaatttaggagaatttctcaagtgttgtcagaagtttaaccctatcctctgcttgcctacagcgatgaacaaatgcaaggagccaacttggggcggaaagatttctggcgtaagatgttcaagtcccagagtgcagcaagtgacaccagcagccagtctgaacaggacacttcagaatgcacgactgcccactcagggaccacctctgaccgacgtgcccgctcacgatcccgcagaatttccctccgaaagaagcttaaactccccataggtaaaagtatgtctgtatttgtttatggattatcttattaccaaccatgtcctcagatcaactcagtgatgcatagtagggccgaaaaagaagaccttcaagtcataagacctagactgacttcattcattcattcatttaatttttcccacagtatttttcaataccctactatgtgcctcttctgtgtgcaatcactacactagccatcaaggattaaatagcaagcaaatacacacagcctcctaactttgctaaacttgtaatatagtaggagccccagtcattaaagcggataatcatacaactaagtgtaattgcaaactatgaattttatgaaggaaatatacatagttctacgaaagcatgcaacaatgagacctgacctgaatgtgggggaggaggcagaaatcagggaaggcttcctagtggtagtggcattaagatctccgggatacttgggagaaggaaggagagcactccaggtagccattatttgcaaagatattaggaggctgaagggaagtgaaggaactgaaacaaggggacaagtggcggtatgactatagtagaatgataggggccagatcaggttgactcttcattctagatccctagatagccaagatgggatgttgaacaggagagtaactcaagcaagtaaactttttgcaaaacttcactgcatggaaatcatactggagggagcataagtagataagggagaccagaaggaaagttagctagtaggtgaggtataagtaaatggaagcttggactgggtggtggccatgtaggcagagataaatgaacacatttgagaagtatttaagaggtaaaattcacaggctttaatgagagatgtgaagctggatagatgatggtttcctttcaacccagattcttttcgtcttggtcccacatgcttatgcaattttatagtctaacactgaacatttttattcaaagcatgtacattgaaaacaatttgtttttctatttataccaagccatgtaactttcatcgcttgttgggcttatgttgacatttctgtttaattgattggatagaaaatgctacattgatctaagtgatttaactattaaatagggaactggctgaagagatcatccctctcaggcctggcagatggtgtggaggacctcctggacattagctctgtggaccgactctctttcatcaggcaaagctccaaggtaaacaggacataacttgtgtaagtgactgttgaagtcgctgatacaaacatgtgaaggctgagaaatagcaaacacctgcaggggccaaataaggaaaagctgaagaaactctccagatgagctaactttggaaacttagataagcaatggaaactaaattgtttaagtagtaggctatcataggaagggaaaaagaaaagtgtggtcaaaaaattatataaaattataatgcagatatagggatgtatatagacattatttcccagctatttttaacttttaacacacctatgaaatgactgacatctcaaactcctgtccaaggatctggtaattttacagtgatcccttttacatattaagacacacataattcatccttttcccactacttttggcaccatgtgaaccactgtctgtattgaaaagaagaaagaatctcgggatgacctttttcactacactcctccttcgtaatactgtgaagcactggagtaacgtaaggtttcttctgagagtccaccctgtggttgcttcatggcctggtcatttgtatgcctaattttcagcatatgataagagttatgtttccttttatgtgtacaaattatttgcttgcattcttttgttttctaatctcactaaaaccagggttgtttttgttttgttttgttccttgtgggtttttgttgttgttgttgttgtttttgttttgttttgtttttgatggagactcgatctgtggccaggctggagtgcagtagcacaatctcggctcactgcaacctccgccttctgggttcaaatgattctcctgcctcagcctcccgagtagctgggactagtgcgtgccaccatgcccagctaattttatatttttagtagagacggggtttcaccatgttggccaggatggtctcgatctcttgatctcgtgatccacctgcctcggcctcccaaagtgctgggattacaggtgtgagccaccacgcccagccaaaccagttttcttttatctagtctgttttaaaagtgatattttgaaattacacaaataatatgcaagactatagcatatttagaaaatatatgtatcattccttccttaccttctatttgctaaaaaacataagtcatgtatttgagtttgtgtggcccatagcttccttgctgtgcgaaaaattttgagtactgctgagctaaaagcaagatgaagaacatattttaattcttagaaagagaaacatgttattacatttttattatagtacactctataaattaccttatactgattctttcacagagatttaaagtattctatttagctatctttcactttggtctgattctcaattgtggtatttgtaaagaatgactatgtctcgctattcattaatttcagtttggactttatcagatttaaactctaagaatatctcaattatttttatagcacctgattatttagcttttaatctgggacctggttcctccttttagttacagtgatgtcttttttggcacatgggaatgaactacactgatgaccaaactaaccagatgtggaagccagaagagcaaagtaatagtatgaaaatgagtaaacaactcattttcaagtcaagagttgatctaaccacaaagatttacctttgaatcttatctctctactttcctttttttttcttttttcaggtcaaattcactagtgctgtgaagctttctgaaggtgggccaggaagtggcatggaaaatggaagagatgaagaggagaatttcttcaagcgtcttggtaaatgtcatgcatcctaagaattctattcaacttttatcacacagaacaaaaacttgattagattaagtggtccattttctattttcattggtttttcattcatttctttctcatacatgccttttaccactgtctatagcttctgtttttgcaatttgattcaacagacatttatggaagccttactgtgttcctcactccatgatgggcactgggttttcaaagagtaagatccagcctcttctgctgttctatcctttattaaaatctgagaactttacaaaacttccagagatccttttatccacccacctatctacttacaaattctgctcagtatatccctgaaaggtggccagccaccctctgcacacttccactgagggggagtttataactttacaaagcaacctgttctagagcaagacagccttaattattagagaatttttccttacattctgaagacatacttatccacaaatttgcttcatttgtcctagttatgatgtctgtaccaagatgcacacacatacacatcacatacactctcacacacacatatcatgcaagctccatatgttatccatttcgtgttctctcttttgatctcactgctgctagttagaaacatctttgatttctttacttttccttatgtggaagtgtctctagatccatcaccattctgattcctttttattatgtattttagttagatgatatgcttttctacaaaatgtggaacttaggatggaatgcaatatgccatatttaaaattaattagtatagtagatagtgtaactattaagcttgaggactacatgaagtatatgaacacaatttaaaattacattttctgttttcatatcacataattggtttgtattgattaatttttgctagctttttttcacatggatgaatatcatggtatactttaatatagccattatttgttcttcatttcaaaaatgatgaaaatttattatttcattaacttaggaggtagttaagtcactcccccaggaaggaaattaagagacagaatcaataattttgaggagaatccattttcaatccttttacactctttccactcctctttgagattaaaatataaataaataagcaaatgaatgaatgaatgaatgaaaagagaatcaaaactaaattgaactctgtcttttcttctttgtactataaagatctgtctgcagagacatgcacattcccctgttctcacccaagttgttcatattattactgaacaggacaaatgcaaagatgtaactctaagaatacttctacttgactttgattaattaataatttgtgggtacagatttttagtgaaccatacagttaattttctagtgatcagagaactttcccatatcactacagaaacatcaccagaatttagcaaaacatgcctatgatatccttacaactctatcaaaaagaacatgacttagttcagcataatgaagttacagtgattcctatgatacttctcttttgaaaatgttcctatctatttaattatctcttaaagaatttggcgagggcaaacatcaagtttattagtctctgtggttttaagaatcttcctaataaccaggacatttgtcattttcaatccttttacactctttccactcctcacgatattttggagacaatatgtctcacggtcagacgtcagtattataaagaaattttcttgtgcttttttgagaatgaagtgtggaactaaagtgtgttctccaggtatgtgtcatgctaactggatgtcatttgactggagctgcaatcacatctttaagttctctttatgcactaaagtataactgaggcttaaactcaaagaatgtagggtctctcacatttggtgaatatttcttcttttttcaaaattccttccttccttccttctcttctctccttccttcctttccttctctctttctttctctttctcttttcttgctcttttcttttctttctttctttctttctttctttccttccttccttccttccttccttccttccttccttccttccttccttccttccttccttccttccttcctttttctttccaaatctccttctttctttctttctttcctttcttccttctttctttttgagacagggtcttcccctgtcacccatgctggagtgcaatggtacaatcatagtccactgccgcctcaaactcccaggctcaaatgatcgtcctgcctcagccttgcaagtagctaggattatggacatgcaccaccatgccccactaaatttgttttacattttttgtagagatgggggtggggggatcttgctatgttgcccaggctggtcttgaactcctggcctcaagtgatcctcctacctcagtgtcccaaagtgctgggattacaggcatgaaccaccatgcctgccctaatatttcttcttaagtgaactttttctgtctgctgcgaactgaatgtgtatatcctccaaaaatttgtcttgaagctctaatccccaaagtgatagtatttacaggtggaggctttaggaggtgattaggtttagataaggtcataaggggagcacttgtgatgcgattttaatgcccttcttaaaaaaaaaaaaaaaggaggagacataaggtctctctgcatgcatacaccaaggaaaagccacatgaggacataaccaggaagagagccatcaccaagaacccgaacatgcggacaccctgatctcagacttccagccttcagaaccgtgagacataaatgtttgttgttttaagtcacccagtctatggcatttcattgtagctgacctgattatggcactatgcttccccgtttgtagatttttctccttggtggaaaagataaaagcataattgacttgtttacactctccttttaattctcctacattctcttcttattcatgttccaaacacattatcattaccatttcttacaaatgttagttcattctggactttgtgtttttattaccacgattcctacggattttagccattgcttcgtatattctttgtattccattcacagattcaaaagatctgatatggaatattcatagagccagattctacaatgagtttgtgtcaacaatacctgaaatgcagtttatttttgcatgtctagaaaacaaagccataatatttgagattgttatctggaatattttatgtgctttgggctggcaagagaatatagcttgtatatcactattctttgcctatgttctcttgctttttaaaaattataaaaaagatattcctttggaattgcttgcagaaaatgagtatctccagcttaaacaacattatctgcttatctaagtacattgtattttgcaacaactactgccctttattgcgcaaacatcattctatttttgagcctgcttttttccttacttccttttctgattccttcctttctttccttctctcttttctttctcttgatttctttcttgctctctctcttctttcttttctttcttcccttctttccttgtttttctttctttcctttgcaatctatgtgtataaatgattcgtacccaaccatgatagatgtgttgtcttttctcatctaaattatcttaattacagaatttctttgtttctttctttaaagttgttaaagagaacaaacatcaaaccttcttaccctcagtttaaatgcagtactttaacttcactgatttgagatgaaatgccaatagaatttctttaaaatttaaaagttattcaataaataaaaactgtatctggtgaacatgaaatagaattgaaattacattcagaaatcagctttttcttttgtgttttcatattcactgaaattatttcattttaaaaatcatgttgtctctatttgagggaaggtgtttgatcaattaaaacaatttttttcaagtaatcaacacgtttactgcacatcttgtatgttctcagctgtgccatcaacacaatgggaaatgctgcttaaggaaatactagatttcatatgtctgaaactttgtacccataagtgtatatgataatgatttgccaactaaaaataatattaaaaaacaagtaggatatttttatacatcccttattggatttaaaagcttataaaaatgcattctacgtaaatagaattataattacacctcaatatacacctcaacataaaaaataaatattaaacaaatgcagctaaaatatactgaggctaaaaaagtaatcgttatgtctaaggaagccaagaggcattcttacatcctagtgtattgctataaaaaattgattaaaaaatacattttgcagccaaattactttttgacatttcttttagtagtacaatatggaatgccagcaggatacaattttatcatcagtgtatcattaaaaatacaggagaaaacccaagaaatataatatgtacaatgaggaattatttcttacattaagtttttctaacatgatcactaccttcagcagagtataaaagtctgaccttcttccatataaacatttggtattttagagattacattgtggcattgtggtaagagtgcaggtttgtgcactctcagtggatctgaatttaaatcttgcctttataactgtccattgtataaacagattgggctacttaacctgttccttcacctgttccttctctctttatctctctgtctctgtccaccactctctcctcaccaacagacccatacaccccaaaaatacattctcttttaaaataattttaaaaacttatcttatagggctatggcaaaaaataaagaaaattaattataaaatatttcatacagtacttgggatatactaagtgctcaaaaatagtaccaaaatatatcaaaaatatattcttatctattaatgctatataaatacaatgctatataaatacaatggaaaatgtccattataattagcttttattaataacatgattcttacgtcctgtgcttataggattctgctgatcttctgacctgtaataaatatatattattctgtgaagcaaagaatataggttcttgctgtcagtgaatgttttgatgacttctctcttcattattttacctacatcccttaactgcattatttctgaaattcttgcaattaaaatggcatttcttttagtagtattgaatacaattcttttgaaattggtaatcttgtcaaataaaaattgaagaaatttgtgaaatacatattcttcatgcttccttaaataaaatgatctcaactgttcttaataaatttgataaataagaataacttcattgatcatctatctggtcttatatattaattccattacaaattttaggcagttattacctaatgtattttaaatcttaattatagcaacaaataataaaacaactggattcacaaaaaagaaaaatcttattatttgaaatgtctctttaattcaaagtttaagggactgtttatactttttaacagatgagaatcctttggtatacatattagtatactttatatactattaaaggggtatatataaatgattaataaagtgacatatagttataaaaaataacaggaatttacctgttctagtagctttggtaatgtccagtgaggaaatagagtagcattttgaaagggagctgcttgaaaacaaggctctcctggaattgtttgttcctcgtctatagcttttcttctttgtatcatttgagattttgtcttttgaattttttccaccatcagattcttctcatggtagttccttttgcatatgataaaaaatatgctatactaactggaaaaaaacactgaaggtattgaattttgaacttttgaatatggaatatttgcatctggaaaagaaacataaccataaagaatgaaatataggaaatttcaataatgatactttatcttctgagccatttttgagcttatgaaagtgttcaaacgtaggcaaaaagtaaagagaatggttcaatggatgcaaaatattcatcacacttgcaaaaataatttagaaatggccatatttgcttcatctatctttcatgctcttttaaatgtattgtacaacaaatcacagacatcatgttatttcatactgacatacgtcaatacgattgagtcattgtgaaagttgtagaccaagattggtaattatttttatgccttgccataatttttaaatctggtggtaataaagtctaaatgaatctgtgtcccaggcttaaactgcttccaaaggatgtgtcccctgatagagtaggttcccgcatttttccattagtggatatagtggttgacatccttgtatgtggtgcactgtcatggtaaacccaggcccataactgtaaacacccccttttatctactatgaatgcaaattgttagagtggtaaccctaactctggacctccagtagccagtgattctttgcactgtaactgagaaaaggtttttcctttcaccacagtgctgtaccaatttgtacagcatgctgtacccaatgtacacattatacacaatgctgtaccaatgctgtatcaatttgttgtaacagatctgaaattgcacagtgattgcaacttccataaaaacagaagttgttgattacaggaagaataattttaaatacaccaaaagctcttactagtattcaaaagaagacctgcaagtaaaatgatcaaacactgtatttaaatatttaggtaaaatcttacattttcatatgtcatgtgtcaccagattcccaaaagtcaggatgtgtttaaatcaaacattagggtggagagcaaggaagtggagtgaaggagaaagttttctggccaacactgtagaaaacacactgttatatctttgaaactctttttaaacctgtgatcctttacgttctctctctttcattcctccaccatggcaccacctttacaggttgccacagttttgatgatcatctctctcccaaccaagatggtggaaaaagcaaaaacgtggtgaatcttggagcaatccgacaaggcatgaaacgcttccaatttctgttaaactgctgtgagccagggacaattcctgatgcctccatcctagcagctgccttggatctagtaagttggtgaaagaattttcccaccctgccccccatcccaagtagcactattaacagaggtaagcatgattccccaattgtaatcctcctgtgtttgtttgtttgctttttcagaattagtgataaaagggggaagaaagatggtgaaaaagggagaaaaatcttaattaatatgccctgggaaatagactgtctaaatatgtgaaggctctggaatcagactgactgagttaaaatcactctgacatttaccacctgaacctctgtaaaatgagtgtaagagcaataacaatactatagcttcctcctcgggctagtgcgaaaactaaatgagatattagatataaagccctcatcacagtgcctgaaatacaggaactacacaataaagtgggccattattattatattattggtcttatgtctgccatgtattagtcctttaagctcaccaagccttgatttcattatccatcaattggaggaaaaatatgaagcaagatcaattgaaatgaattgcacaaacactttgaacattgtgtgctattatacacgtgtaaaggattaaagagtatgaagtggatcttggttagaaagtgtttttatcaggtaaattaggcccacatgtgagttttgaactcagcctctcaatttatttatctttatttataaagtcttcatatgatgcataaacactgggtacaaaataccaagtaaacatcaggaaaaaaagtattttattttaacttttaaagaagacaaactgaaatagatttttattagaacaaaaaactttaagcctgccaataaatgatccttttttcgggttttatgacacatgaataagtgaccagtggtcactcatattttaccttggaaaataatccaagccttataatgtaattcatgaaatttctctgtgacatttgcagcttttgctctaaggatatttagtgaccagcaaggtatgtggcttcacttaaggctgaaatattaataccacttataatcacccaaaatgattgctttccgttatataagatttttttcagtcagtttctcattattgggtagtgacctttgagaattttttaaaaattgcatcatgttcaatgtgtgttgatatgtgccatggtgactgtaaaatgtagaaaatcacaggtctccaggagagctggggtttgtggcaattaaacaatcaaagtacagtgagatgtctgtctaaagcaggagagcttgacaaggcaaggagccaatcccctgttttctaggtgggatagtggaaacttagctgtcactcttttgagtcctgcatggtttgtcttaatcacatcttgctctgttcccaaaggagcagattaaaataaataaatgcaacaaattcattagaaaagaacaaacaaacacttaaacaatggaaaagtatatgaacagccagtcaccaaaaatactaatagtcagtaaactacacttcatcttacttgaacttaagaaatgctctgttaatttacaagttaaaaaaaaggaaaaagaaatacctattaaaatagccacagattcctactttatagctctcaggttggcaatgatttgaaagtgctgatatgagtggaagatatcagacaccacgtgcagtgtcactactggtgtaagcagcaggatttgattaggggacagaaggaattcttggactaactggttaataatgagagcagtgatggtgagtggagcactcctcagctcctccctgagtagtaagtaattttggactgtatataatcggggagggagagtagcagttctttacatatcaaatacatcaaatggaaagggtggtggtatttagaagcccagagtcaatgtgagttataagatactcaccatataataattaattaactcagcaaatgtcttttgagggattcctatgtgacaggcatggttctcttagtgataacacaacaaaactcaactggagggctgcacctatttttccctttttccaatgaagattgtgtttgtatagtgattttttttccggatgtcttagtgtacagcattctaaggttgattgatgaatgattagtatttattgtatgcccaccgtgttgccaaaggaaaacactgaagctcagaaagaccgattaataggcaggactacaaagtcagcaaaggatggagccagactggaacccgggtctatcttccaagcccttcagttttgtattctaccatactgactctcttattaaaatattatgtgagaccatttactttaaagcatgcaataataataaattccatattttatacccaatagcttaaacgtggttaggaaagtgaaggtgacagaggctggttgatctcataagtctcatggtaagaaagaaaatgaaggagcgctggagcttataagcagtgtcttttgagccatcaagtaaagaggcattttctcattagcatatgtgtccactgactgagtagcctgcatctggaagtaatgaggtctttgccactagactggatccagtaggggtgaatgtacaggaggatcaagcagtgtgtgggtagtaggagttcctttcatacctgacagtctttgattcaaggtcaaggtcaagctgtgtgtagtgttcagaggtccaaattccagaggtcagaatcaatcaagggttaaaggagctcagtagttcccattatgaggcaaaaagagagagaatctgggtagacatgattggttggataaaaggcataggtgatgatggtggtggtggtggttggcagaggtgttggtagagaataatactcataacattttcattatgcttgatggtttataaagcaccttcacattcattgtcttatttgttggtatgagagcaaaagaattaagccaagagatgaaccccaaataaggacacacttacaatcagtttctcagctatggaaagtgaaggaactaaaggggctggtgaattctgacagactgagaggaaggtaatgcagctatatgtcgtacgtgcttgaatcaaagcagcatttggtgtttactgtcatttgtacagatgtgataactgcaattgttcatacctattgatctgggttaggggttcctcagggttatgctaactttcactgatgttttctgctaaaggtatttttagcttttgtttcctttgtatttggtttcatccaatatgtgattcaccaacttccaatctttcaagaatgcctcagtttttaagtatgttttacgtgtttttcaatgcattgtggttttatttagatatatgtatataatataaatagatgtaaatatagaaataaacatagatgtagatatgttaggtagatatgcaaatgaggtacacatgtggatctagatataggcacagatacagatatagatatagatagatatacatatacagagatagatatacatatacacagatagatagagacatagttatagattccgccatttcatcaaatagaatttggaggaggaggggaaaaatgaatgtgctcaattcatcatcatatttcaatcttgcattttctcccacctctcttttattgttttgctttgttacatttattttttaagtgcagcttaaatacaatttttgcattttgacataattttatattagaatagtttcattgttttatgtccttaaaaatagaatttaaatgtgatttttttaagattgtaattttcttcagaattaaaaagaattgttagatgaaagaaatactagaaatgtcagtgttcaaagttttgctgacctgttttttttgttggttctaaacaatgctacttttattattgctatgaccactaaatgtagggataattgattcaattttaagtccagtacagcttttcctcacaatctttctctttagggttaatttagcagatgcaactgtaaggcattttttaaaagacatattttagaaaggattgatttcatctctagatttatataatctgcaagtacaaaactaaaaagaaaataaaaagaaaaattaaacagttcaagcaaaaggtatgtctacttcctatatttttcaagtgaaatagtcttttcttatttatccagttgaatttgtaacatgcacaagcagtgatttctaattttttggtaatttattagcatgaataacactaataccaatgccagtttgctttaggaacaattccataagtataagaccatccataggatcatagaattctccctagtctgtgagtggaggaaatctaatgttaaattattgagcctcataagtagacagttttagaaggagtgcatatataattctttttcaaaataggacactttcaagagtgaaagagttatcaataattatgtgaggaaaagagacataaaccaggactctcccaggaaaagaccttcagttaccataggtctaattcacacttacttccaggcttattgcatcaaatataattcatattggggcttaacatcacaagatatttaatgatcaatgcaaattaggtcctttcaaggagataggaatgcatgaaagaggaaatatcttatgattctcgtttgaatcataagaaaattagaaataatttagtaataacaaaactaaactatcaaattgtcctcttaatctagtggtaatgaattttttaaaaagagtctaactatgaaatgtagcataaaaaaatgcttgaatagtatttcattgttttgtatatgccacattttctttattcattcacctattgatggatacttgggttgaatctatgtcttggctattatgaatggtgctgcaatggacatgagagtgcagattttaaaaatgaatatacagcaaaagaaactatcatcagaatgaacagacaacctactgaatgggagaaaatttttgcaatctatccatatgacaaaagtctaatatccagaatctacaaggaacttaaacaaatttacaagaaaaaaaacattaaaaagtgggcaaaggatatgaatgaacccttctcaaaagaaaacatttatgtggccaataaacaaatgaaaaaaaagctcaacatcattgatcatcagagaaatacaaatcaaaactacaatgagataccatctcacaccagtcggaatggtgattattaaaaactcaagaaacaacagatgctggtgaggctgtggagaaacaggaatgcttttacgttgttggtgggaatgcaaattagttcaactactgtggaagacagtgtggtgattccttaaagacctggaaccagaaataccatttgacccagcaatcccattactgggtatatacccaaaggactataagtcattctactgtaaaaacacatgcacacgtatgtttattgcagcactatttacaatagcaaagacatgaatcaacccaaatgcccatcaataatagaccggataaagaaaatgtggtacacatacaacatagaatactatgcagccataaaaaggaatgagatcatgtcttttgcagggacttgaatagggctggaagccattatcctcagcaaactaatgcaggaacagaaaaccaaacaccacatgttctcacttataagtgggagctgaacaatgagaacacatggacacatggacacaggggaacaacacacactggggcctgtcagcagggttaggggggcaggggaagggagagcatcaggacaaatagctaatgcatgctggacttaatacctagatgatgagttgataggtacagcaaaccaccatggcacaagtttacctatgtaacaaacctgcacatcctgggcatgtacccaagaacttataaaataaaataaaataaaatgaaacaaaatgaatatatatcataagtacatagaatttaaagaaaaaaatctaaaaatcacatatccatgacacaaaacatttccagtttctgtgttcccttacctaatcacacacctttacctctgagaagatactgctcttctgaactttattttaatatctttcttgtgctttattttaccacattggtatgtgtctttagagaatatattattttattttgttttcatttgttttgtctggttttgaaattaacttataggaagtcatgctatcctctttcttatttgtttaacattatgtttgagttcctccttgttgatgcatttagtgttaatatgttaatgtttactcatgaatggtattcatttgtttgaacataccacaatttatatgtccactctatgttaggtgaacattttaatttttttcaaaattctggctaattttagcaatgcccttattaatatttttctgtatgggtctctattcatatatagtttcctaaataaacctatgagtaaaattattgagttacaattttactatatgataccaaattgtatttcaaagtagtttcaaaaattccaaataagtgccaacgatataatgaaaactcctgtttctctatgttcttgccaacactgtattgtccaatatttttatttttaacaatgtggtgctttaaagtaataacctttaatctatattttaacctaaagcttaagaagtcttgtcatcagtttatttactatttctgtttctgctttggtaaaatatttcatttgtgtcttttgttcattctcttattggaagattatcttttattgctgatatttaaaagattataggtgatgtcaatattaatcttttttctgttcattacattgcatcatctcccagtgttcagcttgttttcttcttcaattttttcatacattttaatgaagagattttaatttaatataattcataaaaattatccttcatggctagcacttctgtcttgaaattccaaggtagcaaagacattcttatatttttctctaaaagtattaaagattaactttcacaattaagtctttatgttttatgtgaatagtataggataggaattcattttctttattttctttcattctcgtggaaaaataattatcctagcacaatatattgactagttaatgcattcttctcagatgtgcatttccatcttaatcaaatgtcaggtgtccttataagcatgatgtaattctgggttttggtttttttgtttacttatttatttatttatttatttatttatttattttttcgtttttgagatggaggcttgctctgttgcccaggctggagtgcagtggcatgatctcagctcactgcaacctccacctcccaggttcgagtaattcttctgtctctcagcctcccaagtagctgggactacaggcacccgccaccatgcctggctaagttttgtatttttagtagagaaggggtttcaccatattggtcaggctgatctagaactcctgaccttaggtaatccacccaccttgccttcccaaagtgctgggattacaggtgtaagccaccacgcctggcctgggttttgttttattccattttccatgtatcctgagtcaacctactctgtattaatagttagaacttaaacatcacttaggctagtcgaggctcttcgttcttccacatgaaattttatagttagcttatcagagtccatgaaaaatcatttgatttatacttggaattgcattgagtccacggatatatttagagatgatcgaaattgaaatctgaattgattattgaaaagttctatttcttcctgagacagtttaagtaattttaattttttcagtagtttatcaatgtaatctatattttaaggtttgttggcataaaattgctgagaatacattcttattagttctaatctttgcagtatctgtagttacctatttctatttctaaaattgtttccagttttttaactagatgtaccagtcatttgtctatttcatttttttaatctttctattgtatgttctctaatttattaatgcttgctcttatttttattattttctctcatgctttgggctaattgcattattctttagttaagttgattacttagttcattgatattcttttctctattgtaaactaagaacttagctattaattttcctctaagtactactttaactgcataccataaattttgataagcagtatttttgttttaatttacttttaagtactttctaatttctttaactatttcctttttgactcataggtatctatatatgtgtgtgttttaatttataaaatccagggttttgttagaaatcaatttgtgttgttaatttctaagttactgattcttcagaattaatttagacttcctttatgacctaaaatattatcagtttttataaatgttccatgtgttgtcaaaaagaatttgtattcgccacttgtagaacacagtgattgatatacgtacgatcaaactcattaattgggttatttgaatctactttctgattgttttctcactgtttgatctatcaattactgttagttgtgttgaaatccctcacaatgatgacaaatacgttcatttgtatttacagtgatgacattttttgttttatttatttggaagcaaacaggtttagaaatattacgatttctaatgatttgaaccatttattactatcaagtggcacgctgatttttagtaatactttctaccttaagatatgtttttctacaaggctaatagatagctacaacaatttcattaggttagtattggctgggcatgtctttttgccaatcctttactttcaacttttctatctgtttgttacttaggtgtatgtcttattaaaagcatgtatttgggccgagcatggtggctcacacctgtaatcacagcactttgggaggccaaggtgggcggatcacttgaggtcaggagttcaagaccagcctggccaacatagcgaaaccctgtctctactaaaaatacaaaaattagccatgcctgtaatcccagcttcttgggaggcagaggcacaagaatagcttgaacccaggaaacagaggtcgcagtgagcccagatcacacaaccgcaccctggtctcggccacagaatgaaaccctgtttccaaaaaaaaaaaaagaaagaaaaaaagaaaaaaggtttatatttaatttttttcatcatttaaacaatttttttctagaaaatttagtctatttgtgcagattgtgattactgacatatttagattcacttctgtcatttttgcttatttattacactttttattttttcattgtgtgtgcatgtgtgtgtttgtttcaatttcatgcctccttttagattgtgttagggtttatttctcttgctttggtatagtttcacattttaaaagttattttcctttactggtttgtagattattatattccctttatgtttatagaaatcacatacatatttaactaaaagtctaaaatcaatgaatttcttttttttaaatttttttctaaaaaagaaggatacatgtgcagaatgtacagatgtgttacataggtatatgtgtgccatggtggtttgctgcacctattgactcatcctctaagtttcctctcctcactctccatcccccaacaggccctggtgtgtgctgcttacctctctgtgcccatgtgtcctcattgttcaactcccacttatgagtgagaacatgcagtgtttgattatctgttcctgtgttagtttgctgaggatgatggctgccagcttcatccatatccctgcaaaggacgttatctcattttttatggctacatactattccatggtgtatatgtaccaccttttctttatcaagtctatcagtggtgggcatttgggttggttccatgtctttgctattgtaaatagtgctgcaataaatatacgtgtgcatgtgtctttatagtagaatgatttatattcctttgggtatacccagtaatgtaaatcctgggtcaaatgatatttctggttctagatccttgaggaatcaccatactgtcttccacaatggttgaactaatttacattcccattgacagtgtcaaagtgttcctatttctccacagcctcaccagcatctattgtttcctgactttttaataatctccactctgaccagcatgagatggtatctgattgtgtttccgatttgcatttctctgatgatcagtgatgttgagctttttttcatgtttgttggctgcataatgtctccttttgaaaagtgtctgttcatatccttttctcactttttgatagggttgttttttcctgtaaatttgtttaagttccttgtaaattctggaaattagacctttgtcaaatgggtagattgcaaaaattttctcccattctgtaggtggcttgttcactctgatgatagtttcttttgctgtgcagaagctctttagtttaattatatcccatttgtcgatttttgcttttgttgcaattgcttttggcatttttgtcatgaagtattttttgtcatgaagcctgtgtcctgaatggtattgcctaggttttcttctaggatttttatggtttggggttttacatttaagtctttaatccatctcgagttaatttttatataaggtgtaaggaaggcgtccagtttcagttctctgcatatggctagccagtattcccagcaccatttaccgaataggaaatcctttccccatcgcttgtttttggcaggtttgttgaagattatatggttgtagatgtgtggtgttatttccgaggtctctgttctgctccattggtctataagtctgttttagtaccagtaccatgctgttttggttattgtagccttgtagtttgaagtcagtcagcattgtagtttgaagtcaggtagcatgatgcctccagctttgttctttttgcttaggattgtcttggctatatggggtctcctttgattccacataaaatttagaatagttttttctaattctgtgaagaatgtcaatggttatttgatgggaatagcattgaatctataaattactttgggcagtatggccattttcatgatattgattcttcttatccatgaggatagaatgtttttccatttgtttgtgtcctctcttatttccttgagcagtggtttgtagttctccttgaagaggttcttcacatcccttgttagctgcattcctatgaattttattctctttgtagcgattgtgaattggagttcattcatgatttggctctctgcttgtctatcgctgctgtaaaggaatgtttgtgatttttgcacattgattttctatcctgagacttggctgaaataacttatcagtttaaggagttttggtgctgagttgatggtgttttctacgtataaaatcatgtcgtctgcaaacaatgacaagctgacttcctctcttcctattttaataccccttatttctttatttgcctgatggccctggccagaacttccaatactatgttgactaggagtggtgagagagggcatccctgtcttgtactggttttcaaagggaatgcttccagcttttgcccattcagtatgatattggctgtgggtttgtcatcgatagctcttattattttgagatatgttccatcaatacctagtttattgagagtttttaacataaagggatgatgaattttatcaaaggcctttctgcacctattgagataatcatgtggttttggtctttggttctgtttatgtgatggattacatttattgatttgcatatgtttaaccagtcttgcatcccagggatgaagcagacttgatcgtgatggataagttttttgatgtgctgctggatttggtttgccagtattttattgaggattttcacacagatgttcatcaggctcattctttttatattgtgtctcttccaggttttggtatcaggatgatgctggctttataaaatgagttagggagaagtccctccttctcaattgtttggaatagtttcagaagaaatggtaccagctcctctttatatttctggtagaattcagctgtgaatccaactggtcctgggctttttttggttggtaggctattaatagtgctgcaatttcagaacttgttatcgttctatacagggattcaacttcttagtggtttagtcttgggagggcatatgcgtccaggaatgtatctgtttcttctagattttctagtttatttgcatagaggggtttatagtattctctgatggtagtttgtatttccgtggggtcagtggagatatcccctttatcattttttattgtgtctatttgattcttctctctcttcttctttattaatctagctagtggtctatctattttgcttattttttcaaaacaccagctcctggattcattgattcttttggagcatttttcatgtctttatctccttcaattcttctctgatcttacttattgcttgtcttctgctagcttttggattagtttattcttgcctctctagctcttttaattgtgatgttagggtgtcgatttgagatcttcctagctttctgatgtgggcatttagtgctataaatttccctgttaacactgctttagctctgtcccagatattctggtacattgtctctttgttctcattggcttcaaataacttcttgctatgtggtgcggagaagaatgtatgttctgttgatttgggatggagagttctgtagatatctattaggtctgcttggtccagagctgagttcaagtcctgaatattctcgttaattttctgtctcattgatctgtctaatattgacagtggggtgttaaagtctcccactattattgtttgagagtttagtctctttgtagatctctaagaacttgctttatgaatctgagtgctcctgtattgggggcatatatatttaggatagttagctcttcttgttgaattgttctgtttaccattatgtaatgcccttctttgtcttttttgatctttgttggtttaaagtctgttttgtcagagactaggattgcaacctctgctttttttttttttttttttgctttccatttgcttggtaaattttctaccatctctttattttgagcctatgtgtgtctttgcaagtgagatgggtctcctgaatacaggacactgatgggttttgactttttattcaatttgccagtctgtgttttttaattgggacctttagcccatttacctttaaggttagttattgttatttgtgaatttgatcctctcatcatgaggttatttggtttatttggacactagttgatgcagtttcttcatagtgtcattggtctttatattttagtgtgtttttgcagtggctggtaccagcttttcctttccatatttagtgcttctttcaggagctcttgcagggcaggcccggtggtaatgaaattcctcagcatttgcttgtttggaaaggattttatttctcctttgcttataaagcttcatttggctggatatgaaattctgggttgaaaattctttttcttaagaatgttgaatatggcccccaatctcttccggcttgtagagtttctgctgagaggcctgctgttagtctgatgggcttccctttgtaggtgacctggcctttcactctggctgcccttgacagttcttccttcatttccaccttggagaatctgatgattatgtgtcttgaggttgatcttctcatggaatatcttaatggtgttctctgtatttcctgaatttgcatgttggcctgtcttgctaggttggggaggttctcccgcataatatccggaagtgtgttttccagcttgtttccattcttctcatctccttctggtactccagtcaatcgtaggttcagtctttttatgaagtcccatatttcttggaggctttgttcattccttttcattctttttttctgtagtcttgtctgcattccttatttcagcaaggtggtcttcaaactttgatatcctttcttctgcttggtcgattcagctattgatacttgtgtgtgcttcacgaagttctcatactgtgtttttcagctccatcaagtcatttatgttcctctctaaactggttattctagttagcaattcctctaaccttttatcaaggttcttagcttcttttcattccattataacatgctcctttagctcagtgtggttttctattacccatcttctgaagcctacttctgtcaatttgtccatgtgatctcggtccagttctgtgcccttgatggagagacgctgcgatcatttggagaagaggcaccctgacatttcgggtcttcagcattttttcgttgattctttctcatcttcgtgagtttgtctagtttcagtctttgaggctgctgacccttggatggggtttttgtgggggcttttgtgttgttgttgatgatgatgctgttgttgttgccttctgcttgtttatttttatttcaatggtcaggttcctcctctgtagagctgctgcagtttgctggggcttcatttcaggccctattcatctgattcactcctgtgcctggagatgtcactcaaggaggctggagagcagcaaagatgggtgtctgctccttctgggacctctgacctcgaggggcaccaacctgaatgccagtaggatcacccctttatagggtgtctgacaacccctgttggagggtttcacctagttgggtggcacgaggaacaggacccatttaatgaagcactttgtcctttggtggagggggtgtgccttgctgtggggaaacccacccgtctgggctgcccggattcctcagagctatctcagggattcctcagaggaaaggctaagtctgctggcccgaagaagagactgaggccaccccttccccagggtctcaggcccagggggatccagattctgttcctgagcctctggctggagttattggagttcctgcagggaaaccccaccccattagaaaagaggggtcagggtcagtcctgaagaggcactctggccgcagactgccacagctggtgtgttgggctgtgggggacttgtcttgggaccaagctgtgcagcttccctggcaccaacaggggaaaagcacagccttgggctatagagatgggtgccacccttcccctgcccagggagcttagcatgttaggtcattgcgagtcccactgctggctgctgcccctcccacaaggagttcaaatggcttaaacagcaggcagccagtgctggtcgcttctcccaccgggagttcagtaggcttaagcagattccagctgagaggctgttaagagtctgcgcattctggggttgcgatgctaggctctggtggcgtgagttcgtgaggggcatcttcggatctgtgggttgcacaattccatgttaaaagcacggcttctctgcctttgtagcatgctcactcactgcctcccttggcttgggggaggacactccctggccctttgtggctcccaggtgcgctgccgcaccacactgcttttctttctctccacgggtcacggcagcctcttagttctgacgagagaacctggataccttggttgccggtgaaggattcacacgtttattatgttttttttttcaatgggagcctccgaacgctgctgtttctagtccatcaatgaattcctttactcttccctcaaaaaataagagggtttcggccggtcgcgatggctcatgcctgtaatcccagcactttgggaggccaaggcaggcggatcgcgaggtcaggagatcgagaccatcctggctaacacggtgaaaccccatctctactaaaaatacaaaaaattagccaggcgttgtggcggacgcctgtagtcccagctcctcgggaggctgaggcaggagaatggcgtgaacccgggaggcggagcttgcagtgagccgagatcccgccactgcactccagctccgtctcagaaaaaaaaaaaaaaagagggcttcaaccccaattgttgttcctgttgttcaagatttagttctatcttgcttttgcattaatattcacaaattagacattatttgtattgatttttaggtaaatgagttttaaatttactccccaaatttaacatattctttgttcaccattttccttgcatcttagatattcctcctaagattatttcagaagtgtctttagtgacaatcaattggcagtagatctctcaattacaatttaattgaaaatctctttattttgatctcaacttgaagatacttttgctagaattgtatttataggctgacattttctttctacacttcaaagatattatctcattcctttctggcttaattgacaatcctttataggtaatctgccctcctcccactgtagtcactttgaatatcttctctttattgtttatattttgcagttttactaaaacgttcttagcatttttcttatttgaggttcattaggtacttgaattatgtaattgaaatacgatatttattctaaaaattctcaacttatcttttcaatattgtgtcgttcacattttctttaatctttccttctgtaaattgaaaatatataagatagatcttttcattttattttctgtttttgataacctctctttcatatttttcatctctttgtctctatgctaaactctggataattttatcagatatattttccacttcaccttttctcttttcaactgtgtctgatcccttggttctcaacaaggggcagttttgcccatcagggaacatttgacaatgtctggaggaattttcagttgtcacaacttggggattgggtaaataccaaagatgctgataaacattccataatacaaaatgcacccccacacacacacacacacacacacacacacacacacacacacacagagagagagagagagagagagagagagagagaatcatctgacccaaatagtcaatagtattgcagttggaaaaacctgatataacctgtgttttagtctatccattgagttttaactgtgttttagtctatccattgagttttaagtttcaagtactacatttttatttgtaaaaattctatttaaattttgttttaaaatttcctaatcaactttcatcatctaattccttcatcatactttcgatactcacatttatctttaaatgtgtttgatacactacgattccaatcgctgtagtctttgtgaacttcattctgtactttatttcttctgactcttgttcacagtggattattttatgttgtactttttattgacacataatagttgtgcacatttatggaatacttgtgatattttgatatatgtatacaatgtgtaatgattaaatcaggataactggaatatccaacacctcaaacatttatcatttatttgtgttgggaatgttccaaatcttctcttctagttattttgaaatataatgtagctcattccttggcactttatctgtaggaattatttaagacctgtgttagaagtagtgtttttcagtggaccagcaacatcagcatcacttgtgagcatgtgagaaatgcaaatttccaggccctacaatggatctactgaatcagaatatctggggatggagctaaggaatttattttatccatcttcctaagtgacgcctaggctcaaatatgaaggtttgagaagtgctggtttgaagtatttctccagagagaatttccatttattttgtcagacacctggaaacattatcaatctaagaacattttaaaaattatttttgggggctggggggcatggaattagcccattctcggtgctccaaacttgtatgagaatgtgggattttgttaagcattctcgtaaaagactttttccttttgtttctccccctctgtcctacccagagccaaaccttgtcaggcaaaccaacttctttggggcagattttttcttattcatccactgagggtggctccttcctgagatcctggctttatgtcagaggagtacatgtcctgaccaccgacccacttgtgccaacttttaacttgtggcccattggaaacccatccggtctctctatagtcagcagaaaccttcaggacaaatatttctatctagtttatccctacccccaccctcagaattgcactttcttgtaatttctactctccagttgtcttcgatctcactttagaaacaaaagcaaaataaaaatagacatttttggatattttacccaccatttcaggtgttctaaatcaaatgaattcttcactcttacttgatcatattgtcagaaacagaagtcctcatttggtttttaaaatacccaaaatattagcatgatctgagtaagtgctaaaatgactagccttccagaccatgtgctaacctgtaatgttggtcttcagcctacccacagctactgtagaaataggcagggatggaggcagcctgttagctagtgagtcagttatttattgatctcagtctggcagagaattcaatacagctaagtaataaatactgactcagaagtatatgccccctagcaaagaactttggaatgcctactaagaccccaaataactgcttatttccattggttgtagataaacaggtatcctgcaccagcaacagctttatattttattttgtaaggcaataaaaaatatgtaattccctaggggcccacataaaatatttagtctttaaaaacagttagtttctatctagtgttatatgagttttcaggatcagtcaagatttcttcgcacattgtaagcttagatatagtcctccagggaaaggaaggcattgcaattataagcttcaattaaccatcatatcttggcaacaatattttttaggtccccaggcaaaataaagcacagctatcgaaattagtatctcaattctctgcctcactttcataaaggaagtattcaatatacataatgatcttataaaattcaaggaaaaaatggcaaagaagtcaaggaaagtagccagactcctgatgttttctacctgtagactgtaagagactcccatgctgtgcaatgacattcattagactttttgtagtttcaactggacaaccctgtaacccatgcagagaacacctcatacaagattgaactatatgaaattgctgatacgactatttttgaccttcgaatttagaaatttcataggttcaatctaatattttgccttcccagttaaaatcgattcttgcttgtctggaaactacgaagttataatataatggaatagaagcctctctgtgacattatggagcataaaaagggatctgggcagacatgttaataagaaagaagaaatttaaatatgcctacttttcttttaggaccaccagcaaattctctgtggtatgccagtggtgtcaaattttgtttagatgttcacctgtaactgtgcctctgatactctgtggttcttttcagctatgcggcattcttctgattcatttttctccatttgtgctgtttttctctgtgatgtgaatccatccctatccattatgtcatgcctccatcttttgctgcttcttcagattgcactgagccataagaggtaagctccatcaaaagagggaaaattgactttcctttatgctcaggaagaatcctttgtccaaggtattccataaccctgcccctgaaatcaatactctctaaactaccttttaaaaggaactgaatgaaaacaattcctcatagccacactcacaccagaattccttgaatgctgttgcacacacattgcaaactcagcaaacttaattagctgttgcttactaatgatcttggacattattgcccgtagatttgtaccttagcatcaccctcaattttcagtatagtaatatatatactaaaataccccagaaattggtattatttactgccatcttaaatatagaatttctaagcctgccatcatccaccaggctaataatgattataataaaaaggcaatatttgagtgactctatgtcatcatccttgatggaaacagtgacatttccaaacatgaatgggtttggctatttacatgcataaaattcatcagataattaccaacctcccccttatgttttaccatatagttaatgagaattattttcatattgatctcaattgcatttccaaacttggattagaatttcccacagcctgtaactgataatatctcagttttatcctgagaagtttttgagcacaggagaattgaaattggttttgattcaaaaatgccttgggcttcttaagcaactaaagtaatttttcagcaatatatttttaagaattcttgtatctaaagaaggcaagctaatccatataagaagccttacatatcactatttagattgttcattcatctattgttaatcctctcagttgccatctaacacttagaggcaataaaatgatcctctaccccatacatatggtccacgttaagtttcaaccttgttaatcctgaaggagccagggttcacaatataatgctatttcagcagtgttacctatgtctttctgtcattaagctttgaatccacattgctttatattggcaatgtgtcatattgtgacaggctaagaataaatttgcatcacttgcctgacctctaaactgacattctgttttagagacaaacgttccaacctttaccagacacagatttgcatatctgaactgtttagtgaaatgaatacttaatacaagaaagaatgtagatatttagtctatatggcatggcactgcaatactgctgggtttaatgcagaagatcatctgactccttgcaatctcaagtttttctatccctgtgacctgcttcctagtcttgaccccatgcattgatgagatagattctcatcattagtatccaccttttgttaaggatagatactcactattagtgttcatcttgcattctgtctttcacataggttaatttttcatgttgtggtaatacataatattctttgtaaaattaagtacctacataaatatattttcattgtaatttttgatggctgcatttaagacatatacaatgaagaaaggcttaaggaactaacttacttgaatcatccagtgtgtttgggatactttggtacccaaaaatgtaaagtaaccagctctgcctgtccagggaagggatttaagaagggttctcagaggaggtaactaactgaatcctgaatcttaaaaatgggaattttctggatagaaaaggagtttcaaggctctgcaagccgtgagacaacatgtggaatggcagaagatgtcatatttgggagatagcaactaagttgacataattggaccataaagcacttgagatgggcatagaaaaggagatgacccaaatcacaaagcttggatatctttatttgttttatggttgaggtggatggaggctataatagatatcaaatggggaaatgatatgtttatatatttatgttttagaaaacaatagtacatgggactaatatcccactttaagtattaatagttaatttctacttgcactctacaaattatcttttactaagatttatgggagtataaattaagacaatgtaaatgccaaagagaaactagcataggaccagcatcaatgagacctgggttgaattttatgttcctatattcacccctttcatgctatatgatagtgaaaaattatacctcattttaaaaaatcttaaatgggggacattatttatagatcacagggatgttatatattataattctaaaagttaactgacatgtaattgacagtctatgttagcctctattttaactttatggattgatacattgttaagaatactactgcttaccattattaaaaattatttcaatttgaaaatctgtggttactgagtaacctatggttattagtaaccctaaaatgataaataatattgtgatgtattttttaaaaaactgacacaagtcaaaatacacatgaatagttgatatatattttcttatgatctattgaccttctatggaaaacttctcattacttctttccttaactttttttaaaaaatctttcaaagatttcagtagagtatttgattcttaccagattctggatatcagctaaaagatgtttcttcttttttcttttttttttttcaagcacattttgacatgacaaggtggagccatgtctttctgaagaaatgctctatcatttatcaattaatctcctctttatcaaacattttcaattaaaaccatgcctatttaagtataatccagtcagttatttatgacaaaataaaaaaaaaaagactaactcagcaagattgagcttccttttcttttttgaggtggagtctcactctgtctcccaggctggagtgcagtggcgcgatctcagctaactgcaacttacacctcccaggttcaagcctcagcctcctgagtagctgggactacaagcacgctccaccatgcctgactaattttttgtatttttagtggagatgaagtttcatcatgttggccaggctggtcttgaacttctttttttaatagccaaaatgtgcagaaccaattttacctctttggaacatatggatggttatagacaaaagactattgctggtacaaaattacttctgacgctcttggttaaaataagactggttctagaaatggaatatttgtttgcttcatgtaaaatttagggttcaaaaaaagattcatctttaagacctcactaaaagctctttcactctacactcaaatcgctgtcacccttaaatatacaaagttggagacatgtaattacttgagattcttgagaagaaggagaaagcaacacagaaacctacctaaaatgtctaatccttcaagatccacatttttgggggggattttgctttccagatttctcactactgtgttggccatactgacaccaccctgggaaatatggccaatataaatcaaaacatgaagaggaaaataaactaaaaatacacagtaattccctttaagaccaatttaaagttattgttcattaatcccacattattctttcctaaacaaccctacacaggaagcccctgtggtggccagagcagccttgttcctggaatgtgctcgttttgttcaccgctgcaaccgtggcaactggccagagtggatgaaagggcaccacgtgaacatcaccaagaaaggactttcccggggacgctctcccattgtgggcaacaagcgaaaccagaagctgcagtggaatgcagccaagctcttctaccaatggggagacgtgagctttcggttttcttctataacaattaggttgcttaagtgaagtggagtcattttttgattgattgtgtttgttttgaagacaatttattgagtgtttgttatgtaccaggtactgaaggaaacactttgggaaaaaataagcaactcatttaatcgtcccaataaatctatgaggttagacattactatctctgttttacagttaagagaactgaagtttatacaggtcaagcgacctaccaaattttacatatctattaatagtaagtagaggaaccactattccatctcacagattagatttcaaagccttgcttctaattgctatattcatcaagaattatctttttgaaagtcattgttataattgtaaaatacacccttatttcagtttctattctaatttatattttgtaaggcatgattttttctaatttcttagtgaaattttctcttttgttgatgtgcctcctttaagttgcctgaaagcctttggaaattgcactcacataaacacatatttatgtatgcatatgagtaagtgaataaatttaaaagtgaatgaatgaaacttctttaggaattctaacaaaatggacccttaaaataactacaacttctttaccatagaaggaaaaaaggtgaagaataaaaggaaattcaagaggaccaagtttctgctaattttagacagagctgaacataaacacacataaagaggttccatatattcctcttttcttaaagattacttggaataactgttacaatttccgttaataattcagctgaatgtgtctaccaatgtgcttaccaactaaggtattcttcctccagttttacccatatcttttttgcaaagtgccaaagttattcaaaaggcatgaattgtatttagtatgtgtgcagtctttctgtatcagtctttccttctttatttgctgttctttggattttctttcctatataaaaacatcctgtttaaaaagatacacgtatgtatgtgtgtgtgtgtgtgtgtgtatgatatgttggagtagaacactttattaatgctaatgtcaatgatcaacacttagcactgcccttttcaggcttcgattgcacattatatatgagaagacacagtttctcctatgtaatatctatttttgtaaatcgttgagataagttattatgtgattccattgtacttatccttcatttaattatattcggttttaaccttatgaaggtttatacaagtcaagcagtgtcaatgaaatgcatatcatgagatacatagaggcaccagtaatctctttaatgtggagagatgttccaaccccccatttattacctgtctcattcaaggaaggtcttattgagaggcttctctgaaacaacagtcacaattgataatcccattggcttcctacaggagaggaaaaccattaagtgctacacatttgagagtttcaggtttatagggagattgtcaccaagagatttcacaaacaagtgttttcaggccaagagtcttctgactttcttgcagcatttgacactgccaactgcacatacctctgtcttttgtcctttgtctttttgaaaccatcatgcttcagagtttccttgcacctctgtgcctaattctctgtctcctttcctggtcctctgtctcctccctcgtcataaacagatattctccaggatctctcttaatttcttccaatataacttacttcagggttacatttattcttatatttccaactgtaacctgtaagtacagacttccctaaccatagcagttttcagatcccagacctacattgccagctgcactttggaaacattcatttaatatcctagaactcaatcttccaaaataaaacccttctcctcaagtaaacacattgccacctacaacccttctgagctttctattcttattgataccaccgtcatctgagatgccaacctttgagcatatcccaatctcctcccctattgatcccacctctttcatgtcactgaagccccttaggccagatccccatgacttctcatctcgatgattaaacttttttcctatttggtcttctcctcacagtctcctctcatttaatgcatcctacacactgtcagtgaaaagatcttcctacagcccagcccacccaagatatgacattcatcctcatctcccagcctccagacttgcaccctctaattcattctccaaactgctctcagagtgattaggctacaatgcaaattagagtgtgtttcttatccacttaaaatgctttcagtggccctccttttccctcaggataaaacccaaactgcttagcctgccatcactgccctctccacgacctttgctcagaccattccaagattatgagtgatgaactgaaatgagctaatgtacctaaagaatatgtatttaaatactttcctcctaatgtatgttcaataataatcagttctgacatgaatttttgaaagcagagtccatgcttgtctcagcattcctgggtagctagtacaacatccctggcataagtgatcaggttacttctcccactcagaaactacctttcatccttctcaagaatgtgaaatgaagttcaacttcaagaactgtaggatctgatccaaatctaccttttcagccttcctgtacattatttcctctcacaaaattgaacttcaattatgtggcccctctgtcagtctctcagcacatagtgcatttccatgaacataaatctttcaggaccgtcccctcgaatgtctgctctccccattctccatcagtcaaaacaccaatttgtcaaagtctacaaactttgagaccttctgtgagattttctgtgatcctctgaactaaattttctctttatttctttatttttttatttcagtggcttttggggtacaagcagtttttgaccacatagatgaattaattttatagcagtgaattctgagattttaatgcatccatcatccgagtagggcacgttgtacccaaaatgtagttttccagtcccacagctccccgaccctctccctctctgagctgaatttaatctatcttatgagctaataaagtgtttctagtctctttagccagttaatgagttgtttcgttatgttattacatccctcaatagactgtaagctcgttgagaggaagaacacagacatagacagtcagacatcctatgtttgaatcctgctgagcaaccttgggcaaacctcctagcccctctaaacttcctatttgccaaacagtaatctttcttatgtgggcttataatctaccaaggcacattaaacaaaggtactagtgtactataacaacttactcaactttatgttctatttaaaacctaacaaattacctcacttaataaatatttgatgaatgaaggaagagacgaataaacatagccctgaggcatttttctagctttgggtgagacatagagatctaaattattatttagacatatagtattacaccagacaagttcattttttgagcagccctttaagctttataaactgtggacttaatttaagttgcttagttacaacatcctggaatggtcaatgtagatatttttcccttttgagtctcactatttagtttgttggctccattccagactcataattgtatgtcacctccttaacagaggatctccaaaatagcagcaccaagataagtctttttgttgtggtggtggttttgtttttacgatttgtatcatttgcttaaaacttacccggttagcagctaaaattttagaatcccacatactgcattctccttggtatagtttttgcttcctggtttttagctcctcacttaattccagagtttagggagacctttcggtttccagatatctaagacactcaaaaatgtcttttcatttaaagagtatgagcataatcttcacttagagagcttgagcatgttggttttcagtagtaagtatattttcttacttgctgagaatttagtaacttttctaaatatttgcaaagtatgatacagaaagaaagaagaaacttagctggaattttgctcttacttaaacacagagtatccaaactgtcaaaccccaagttcagtgatctgtttaactttttctctctcactcctgagcctgtgtctcttctattgttgcatgcagtatataattggaaataaaatgaattagatagagatagtgttttttgtctcttcttgtggcaaattcctttgataaaccagacaatagtgcctgatgattcaataacagatagcaaggatgttagttctaagaataccgtgtaaaaaccaatattatccacgtgctgagttattaaaactcatatttctaatgttgttgggcactctaccaaaagaaaagttagcatttcttactaattcatagagtattatggaaagaggaaaaaggtctataaaagaagccaataagtacatatataatgacagatagaaaaaaattgcagcaacagaattcttgccaacttctaaactcattagcatgacagtgacattctcattaaaaatagcataatcagaagcactctgaggaactgtgccttctgatgttttactgcaacaaaatcctccattaaaagcaattgtgtactcccttgtatcatatctataaaataaataacctttgagtaaatggaaatattttcagaaaaacttttgtacaaatatacaaaggtgtcattccagtttttacaagtctttagactgaatgaccttggggatagctgtttcttccatttctggtttccatactggcaaatatggtggaaacaacactgtggcatacagaagaggcttatgctggaaataattctcattaattggttgcttatgtctgatgtaatgtgagagcctattttagagtttgacttagtttgtgctgtttcattgttttccttcccattttaggcaattggcgtccgattgaatgagctgtgccacggggaaagtgagagcccagccaacctgctgggtctcatttacgatgaagagaccaagaggagacttagaaaggaggatgaggaggaagactttttagatgacagtaaggagactccctttactacaagaacccctgcttgtaagaacctctgctttaggagcacttaatacttctcttttctccttcatattcttaccacctccccatgtctttccactgctccttctccccttttccctgtgcatgggtgtaaagcatgtgcataaagccacacagagacaaggcaagaaccagaaagagaagacagagaggggcaaggagctgcaggcaagatggaacatttattcttttcttgtctttgacaaaacaaatattggtattagacttctctgagaaaatatctctgaggcactatagttgtggaaaatttactgtcctagaagagattttgtcaggttttgtgttttttatattgctccaggaaacaaaatcagaccaaataaaattgaatgtgaaatattttccaaatcactaaaatattgaaaattttaaacagagtatattatagtatttaacatgacacttaaatattaaaatattcagaggttgctagaactgtgaatgtctgctgtactgtacctatttattaaatttataatagaatttcatcatagaaaagtagagacaaaaagattcctattacatccttcttcaacatcattttgtgcatacgtgtgttctataccatacaagcttttgtgtatatgtaccactgccttttatggaatacaaaattccagttatagttatggaattcgtatctttatatgatgaacatagtgagatctcttcctcctgaccttcccctgtggtttgaaattcaagctccctgactacatgttaagagttgtccttcattagatgattcagacctactgcattgttgcagtcatgaaatgtaaaagaatggatggggcgtaacattaggcaggactaaataagaatcaaagaaaactcttatgatcttcctttccacgttccttccaaagtttttttttttttgcatttttaaatcatgttaccccttctaagaccttatcaaatcagagcaaatcttcttgacgtagccattgacaaaacaccaaattattatgtcagtctttcaacctaataatgaaggttggccccaaagatatctaaagtagcctagactatcttagaatgaggtttatccaacaatcacggaacctagggaaggcccaccataagacccatctagccagaaggcattctaagccatcctggaacttccaggggcccttcagaacagagagaagttgaagcaacattaaatgcgtgcatcctcctaggccaaaacaacttgaatctccattagactgcataagtgtcatttaccaatatgttctgcctagaatattagttttttgttgagactaggtagaactcaatccttgtttattataacaggatatttaatatgatagccctgaaagagcctagactaagactaagctcattgtctgcaggactggtaagaaaagcctggatgataaccttaggagtgaaacggcagacccaaaagtctatactgaatgtctagtgttcaattattttttaaaaagtgttgcatatccacacaatatttagtcaaatagcccctataagacacatataagattgatatgtctgatttttagttccactttcaagtcaatacacagctcatcttgcatttaaaagctgattatggtgcaagcaactttcgggctggaaattctacagaagcttgtcttttccattcttgatgagaggcaaagtccccggcaacaaattaactcaggagagaaaatggttttcctgaaaaaaacgatagcttaaatatctacagaaagaccgtaatttccacctattttcaaatgaaatcgtgaagtatgtattctattcaattaagaaagcctaacacccaggaaacattttagagatatttttaggactgttcatatgtaatgatattgtgattgcttgatgacttgattcatttaaaatggataaccatttcctttcttttataagagaaagaattctacatggctttgattttttctgaacacgtaaataatatatttctacatcatcctgtgtcatcagttgtgatgacacatatctgagaactaattctgagaattaaaaaaatcactatggtgttaccatggccattatctgtctttagagcaaaatctattagctggcttctagtggatacaatgctttattaattcaaaggtcaatattctgcagagcaaaagagaatatttgtacatttctagtatagctatgccttaatttgacaggctagcttgcacaaactgtatgatatatgtgatccagtaagtatgtcttgtctgtgttgcagaaacacatttggactagagctgaaacaacttcactgccctcaaaacagcaagacagacatccctcataaaatgaactgacagaatttttatagctccaaatctagttcactgccatatacatagtctaaatctgattgaatagcagcgtagaaatcttgcgaaattacttcccatttctgttttcgttaaaaggtattctagtctagttggagctgcattttgttactctatgatgctttaaggaaaataatttagttctgcttgttcaatattttaatactgaagcactctgtagaatttgcaaaatggagggagagagatgcttatgttagtgcataagtcatgctaaaggaataggtaaattgaacttacatagatatagatgaagtcctcatatgtaattggatgttggacatatataggtaacattctcatatgcaatttgattctatacatgtgtagctatgtccatcaaactatgcatttctgtattttttgttgatttgtctccttatgaaagaacactttcatttcctaggtactgtgaacccctctaaatgcggttgcccctttgccttgaagatggcagcatgtcagcttcttctggagattaccaccttcctgcgagagaccttttcttgcctgcccagacctcgcactgagcctctggtggtaagttaaagcatgcaagttaataatcaggttactcggagaggccaggcgtgtgtctgggtttccaagattcacagttttcttaaatgttccatggctagtgtatcacataattttaaaaattcaaccaagggattttgaaacataaaaagaaatgctcttttcctcattacaaataataataactccaaagtcaatctagaaatcagtgaaggttttcctactggatacaatgtttatttgatcactatcaattatgctgggaatatctaggagcctttagcttcctttactctgaaaatatgaggagttttatggctaatgttttccagaactcaccaacaaatttttttataccaactgctcataaatctgtatagaaatttgcttcttaatgagtgttctctttcaaattatggttgaaagtactccagtatttagtgtctaaaatccccaaacgtacattgttatttctgtagcatttcctagagattatggatagacagaaataagaccatgcatgtgtgcatgcacacacacacacacacacacacacatgcgtgcatgcatatacactcctgtgtggtataccatgaaggcctgatttgtttaaccaatgatataaatataaatactatgcaagaaccaggcatgttcacagagtgtgtggcacggggcacaccttggagtcaattttccttcactcctagttctctaatgggcaccaagtttccagtggttctttcatcacaggcatcatccagctggagctgaggaaccagactatctcccagagcaatcgttacataaacaatctatgtgtttccatttaagcaaattttacaatccacaatccaccacctctccttcttttttttttttttttttttgagacggagtcttgctctgttgcccaggctggagagcaatggcgcgatctctgctcactgcaagctctgccttcccagttcacaccattctcctgccacagcctcccgagtagctgggactacaggcgcgtgccaccatgcctggctaattttttgtattttcagtagagacggggtttcaccatgttagccgggatggtctcgatctcctgacctcatgatctgcctgccttggcctcccaaagtgctaggattaaggtgtgagccaccgcgcctggccacgtttcctcctttttaaaccaaactcggcatgagcaaggccgtgtcccaagcaaggccaggcggtgtggggagaggagtgaaagaatgggggttccggtgtcactgcatgacacctctgcctctggttttccggagttctaggaagaccattcattgcttcacactctagaacagaaagtggatattttcaagttagaaatatttatgagtaaactgtctgctctcaagagaaacacccacatttggactgtgacactaccatttggatattgaaaagagaagtttcttctactgcccttatgtaatttcataataacctgaatctttaattttctgaattgtcactttcactattatattgagactactctgtaaaatcaaatcaaggccaccactcagcacttctataggcctctatcagtattatccctatcagcattctaatgatgttgaagtcttcataaaagcacaaagtacatctacttttaagttttcagattgttattggtcaccattttgatccactgtaataaaaaaaataagaatcctaaagtttgactaggttatttttgttttccctatcaattctataaaactagagtttaatggtccttattattgtaacaaatttatttttaaaagatcaatcaaatcttctaaatttgattaatataatttgactaacctacagttagttagcaagaggaaaatttttactttatgtcacctttaattgggcctctgaaatcttttattcattacactaggattttcattgttaatgtgtacgtttgtgtattgtgtcgagatgtggcctttataacataaagagggaaaggacctttttctcacatttcagctatctaaccctagttggtagtaaagaaaactcaagccacattctaacttattgaaatgttttaccaacacagaaattcttacaattgttttctatttttaaattgtggtaagagcacctaccattggatttctcctcttgatgaatttttaagtgtataatatgttattgttgactgtagctataatgttgaacagcacatctatggagcatcttccttgactgaaattttatgcctttctattaagtaattcccccattttgccctcccaccaagtccctggcaaccaccattccactcttttttttttttttttttttttgagatggagtcttgctctgttgcccaggctggagtgcagtggtataatctcggctcactgcaagctctgcctcccaggttcacaccattctcctgcctcagcctcccaagtagctgggactacagacgcccaccaccatgcccagctaattttttttattttttttagtagagatggggtttcaccatgttagccaagatggtcttgatttcctgacctcatgatccgcctgccttggcctcccaaagtgctgggattacaggcgtgagccacagcatctggcccccactctttgattctataaatttgactattttacgtacttactcatataagtggaatcatgcagtatttgtctttctgtgactgtgttatttcacttaggataatgtcttcagagttcatccatgttgtcacatatgtcagaatttccttcttttttaaggctatatggttttttaagaaatggcactgaacagtaaatccacagagtaagcataaatacagccaaaatgacattttttcaccagatagatccttaaatgtaacttaattagtgtgcttccccccctcccccacaaagaaacaacttctggtagcattttgtaaaccgtgcaattaaattatgtctaaagaaagggaagggcagcatttttataagatttatagtctaaaacagcataagcaaattttttctaaatattatcttctaaacttgagaacaacaaaggaatattttttaaacaaaattttgtttataaaactgctggtctactaaaatgtttcccagttgaattagtgagaccaatcgatgatgactaagcaacatgtaatgaaaacagtaattcccatcaaatgcatagatgagtctataataataaagaggaaggtggtaaggaggtctctgtatgtctacattcgtttgttacagaaaacagcatattgggtccttttgtgcaatattgtgctagaggctgtaccaaccatgccaacggaatttaacaaatcaggttataaaaaaatatactgctgaaacttgcttagccatatgcagaaaattgaaataggaccctttccttacaccttatacaaaaattaactcaagatgggttaaagacaaatgattttatcataaagatacatacatgtgtatgttcattgcaacactattcacagtagcaaagacatggaatcaacccaaatacccatcaataatagactggataaagaaaatgttgtacatatacaccatggaatactatgcagccataaaaaggaatgagattatctcctttgcagggacatggatggatctggaagctattatcctcagcaaactaacgaaggaacagaaaaccaaacaccgcatgttctcacttataagtgggagctgaacaatgagaacacatggaaacagggaggggaacaacacacactggggtctggtggtgtgggggtgggggttgggagagcatcgggataaatagctaatgcatgcagggctcaatacttcagtgaggggttgacaggtgcagcagaccaccatggcacacgtttgcctatgtaacaaacctgcacgccctgcacatgtatcctgaaacttaaaattaaattaaattaattctttttaaaaaaagaaaaaaaaaacactggatttcaaaggtttctaaagttaaaaaaatcagaagcaaaatacaattcatagctaccaagacaaaactaatgaatatttattgagaataaagtatgagcaaggtggtgtgatggttgcaggggtggggatgaaggtgatacagaaataactatactgtaacaggagaaccaacatacaaaaaattactttctgaagcaaaatgtaagagggtccctgagaaagtagcagagagccacggctagccaaagaaggggctgaacagctctgatgaaccttcttggaagagggcacatttgaatatagctttgaaagactacgtaggatttggacaagcagataaaagaagaaattggaagggagaactacttttgtgaatcagaattattatatgattgcttcttatcccaactaagaaatttccctcattagatttggctaccacagtggaaggtagattaggttatttttttttctcaaagggattaatttcagggaagcacttacatttatagaatattcttgatgatggtaaaatagattccatgtagttcctatatttttctgggtgtgatataattttctgagtcaaaatgtaacttctgttcttaagccaaaaggacaagaaacaaaatgtagagtctaaaatgttaacttttttttttttttttttgagatggagtttcactcttgttgcccaggctggagtgcagtggtgtgatcttggctcactgcaacctccaccttccagttttaagtgattctcctgattctcctgcctcaacctcctgcatagctgggactacaggcacctgccatcacgcccacctaatttttgtatttttagtagggacggggtttcaccatattggccaggctggtctcaaactcctggcctcgtgatcggcctgccttggcctctcaaactgctgggattacaggtgtgagccactgtgcccagcctaaaattttatcttattgatgagaatcaaaagcataagattttaatcttggtgcaaactttttaaaaatcttttaaaaaattacaaaatatttttattttttatatttatttgaatctaagggtttattatgtcataattagaaaaatacagtataaaaataaaattagaattttatatatatttttaggtactccaaaagtgctttataagttaataattacatatgatcttgaccaggcacagtggctcatggctgcaatcccaacactttgggaggctgaggtgggaggatcacttgaggtccagagtttgagactagcctggacaacatagcaagaccccatatctacaaaaaaattaaaaaattagaaaattaaaaataaaaaagaataaatatgatctctaggataaacaaatctctattcacaggacaagtcaaattctcaatttggggcctcagagaccaaacttctattaagtaattactttcctcgaggcttactttattatatgagatcattgtgttcagcctcagatggtgatggaactcctgtcatacttatatcctcttagaagggagtaagaaattcccccaatgtgtgatactgctttgagcctctggccttcatgcatgaggtttcttaaggctgaactgcctttccccacttgtttgccaaactatctttacttaatcctcaagacttaactcaaacatcaactctttattcattttatatttctgctgtgacaaactaccagaaatttagctgtttatagcagcacaaacatgtcacagttctggaggacagaaatccaaggcaggtattgctgggctaaaatcaaggcattggcaaggctgcatccattcctagggctctagggaagaatctgtttcctcaccctttattcatcatctagaggccacccacatttcttggcttatagccctttccttcgtctttttattattattattttttatttattttttgacagagtttccctcttgttgcccaggctggagtgcaatggtgcaatctcagctcaccacaacctccatctcccaggttcaagcaattctcctgcctcagcctcctgagtagctaggattacaggcatgcgccacctcgcccggctaattttgtatttttagtatagacggggttttttctcgatgttggtcaggctggtctcaaactgccgacttcaggtgttctgcccgcctcagcctcccaaagtgctgggattacaggtgtgagccaccgagcccggcccctccatctttatagctagaaacatcgcatctctctcatctttctttcatagccacagcttcctctgactacagcctggaaaggctctccacttttaaggatttgtgattgggcccatttagctagcccagaataatctcccaatcttaaggtccttagccttaatcacatctacaaaatccttgttgccatgtaaggcaacatattcacaggtcccagggattagggcatctttgtggggctgttattctgtcgagcacagttccgagtctgatttccgagctcctactctcagtcttaaaatttatcacttgtttgccttctcagtttctatcttgggattctgaactcctttagagattaaaaaaagttccttatttatccttcagtacctaacacatccatgcttgatgcatgatttttaaataagagataaaggccaaagatgcagccaaaactgtggacaaagagttagaaggtaaggaagatagttttggatttggatcaaggcctatgcttttggaaggtaaagcatgtgaggaaaaggggaaaaatactatgaattaggaaagattttatttattttttaagtcaagaatagatttgcatggtcacaatctaaaattagcgtcagataaaggaatctggctgtttaaacgcagttgtgtataattcaaaatggtgggaggcttgccgcgagaccaatgcagtgctggggagatgccagcactcatgtgctcctcactggcattttaggacttggagagctgcagacttcgtttggatcccgagttggaccggcacagatatgagaggaagatcagctttgctggggtcctggacgaaaatgaagactcaaaagattctctccacagcagcagccacactctcaaatcagatgcaggagtcgaggagaagaaaggtatggaaacacaaaggttccttcatgtttcagggtttcttgtttctcataggatatttgcactagggtctaaactacaaaattgtgtacccaaattgttgacttcctacaatactgactgtgtaggctttatgatggaaaatcatgcttgttagaagttggtctctgcagtcagagaggcctggcttccaattccagctcagaaactctccatattccattacagctataagatgaaccattatttgatttaccaataaggaaagaaaaatactcccaattgaacttttacataatgctctcttatcacttagcttgtcttttattggttttttttgtttgtttgttgcttttttatttgtttgctttttgtgagacagagtctcactctgtctcccaggctggagtgcagtggcacaatctcggcccactgcaacttccgcctcccaggttccagtgattctcctgcctcagcctccctagtagctgggattacaggtgcccgccaccacgcccggctaatttttgtattttttttcttttcttaatatgcttttattaaaatgtaaaacataataaaatgagaaaaaataatattatgtttctcaattatcttaacatcaatggcatctattcgcacgaaattcttggggaccattacttaatgtgaaactaatttggtaaatagaatctcgttttaaaaactacacctctgctaaacacttgtagggctaatctcatcaattaataaagcactaggcttatttaatcatttttgtgaaactatgaagacagaaagaacagctacagtctttctgcattgctaaatgcacattaaacaagttccctaaccatggaatagaccagatattaaccagatatgaagtttttatatttgattttttaaatgggagactactttatgagtcttcaagtaatatactcagcctacaggttgcttgtaattttttcaatagataagaatgacctagaaaagttatttatggaaccatgttatttaagaaagataaaagtgttacagcgtttacagaatttcttttggcctggctaaggatgttttctagacagtggtattttaaaaatagttcagtattttccatctgtacatatcatttccattataattaacttaaattcacccacttgtatgcacatacacaccttggcctaatttggtcattcatgtttctgtccctctgtccctaggtctttttatttttattttttatactttaagctctgggatacatgtgcagaacgtgcatgtttgttacataggtatagacgtgctgtggtggtttgctgcacccatcaacctgtcatctacattaggtgtttctcctaatgcaatcactcccatagcccgccacccacggacaggccccggtgagtgatgttcccctccctatgttcatgtttctcattgctcaactcccacttatgagtgagaacatgcagtgtttgttttctgttcctgtgttagtttgctgagaatgatggtttccagcttcatccatgtccctgcaaaggacatgaactcatccttttttatagctgcatagtattccatggtgtatatgtgccacattttcttaatttttgtattgttagtagagatgaggtttcaccactttagcaaggctggtctcaaactcctgacctcaggtgatccacctgcctcggcctcccaacaggtgtgagccaacgtgcccagctacttgtcttttattcttattgaaaaaggacattcagacctaattagaagtagtttactattattattattatatatcattcttgtgcaatcctatatgtatatatataaataaaattaactggttaaggtttttgtaaactatcttcaactcagagtttaaatgtcttaattacttttcaactcacagttatctaatatgtctatgtttctatgtgtgataatgtcctctgtggcatcacaatgttagtgatgcatcatttcttaaatggattcataaaaaaagtaaagttttttgtgctaattacttaagccaacttgcacccatatgaagttagcccacctttagtccctcttcagcaatgttgctaaacacatctgacttacccacctcacccacccacctacccctcactatcacttgattccttagggttaaaagatcttgtcactcattctgtttaactttttgctggtgctttacattttcacacagacaagcaataacaaaggtgtcacaactgctacctggtgcaagtgatcataagatgtcatctcttgcatgacaaataccaatttccagatatgttaaaatgtgaacaagttgtgcatcttaaaatgggtgatatatagtaactcactatgtggccttgtccaagttatttaccttctaagccacagttcccttttctgtaaaactgggttaacacctactgcattgcgatgttgaaaacttttaataagacaatgcaagtgaagtgtaaacttaatacctggtgaattgtaggtacacaataaatagctattgttgttgggtttttaaatatacataataagcatctagattagaatccacatagaaaatcctaattatgaactaaagattgcaaagttttaagttgccctctagagcctcctttaaactgccaacttcactatttgattttgccattttaaaaattccattacctttccatgtttttccaatgaatttcaattaaaagaacatctgcacatttgctagaagagtcaaaaatgattttatgtgttgaagtattttctagcatcctatagacaatgactcaataaattttggataacaacaaatgaacgattcttagaaggaatagccctgtatagagaaaacacacaatatttaaaagggaatagatatacattgggaaaagtttgaatagttcaagatcaaaacgttttcacaacatttttaaaatacagataatcatatatcatattctattgaatttatggccaaaagaggccatgttgcaggaaggataagtcaagtcttgagcaatttttgaatatgaagaagtatcaaatgaatatttttttcaaatattacttacttcagacaattatactgcatatgatgagaagcttccctcttttaaacatatcccaaagagattttaatttagaaggcagtcttttctttccttattcaaagttattatgctaattatatttaagatagtagataattcctaatattacacaattaaacttcagcagagtaaaatttacaccattttataaaataaaatatctgattaattttaagaactttaatttgatgtgattattatttatgtaaattggctttaatatttcaacactcaaatgctgaatattttttctacacacagaatggttatgttaacatatgaaagttgtttaataaacaatggaaaactgcagttataagttaaatgagaatatatccataaaatgtccttaatcagttgacgaaaatcttcccaaagattcctaaatattccttaatccatttgacaagctgtcagctactaaagccaatatgaaaatgaagacaatagagacactgctaattacagtttttaaaattttataccatttggttttgtaaaaccttaagatgccagttcttgaaataaacacgctgaggacaattcagattctaccaggaaaaattcaagtgaaataatcatttagaatagtaggagatgggttggaaatgtatgcaaagggcaaacagggtctggtagatgtggttagaaatttaattttgttttaagtgcattagagttgttggtaggttttaccagaaatgtgatataaggtgtgtatttatgatttatgcatttaaaagatgacttaatctatgggagtagagggaaaggtgaagcagttatgcagttacattagtccagggaaaaggggatggagctgtcaaaatcctatgatattttgaaatgtacagccagcaggacttgctaattgatacaaagtgaggtgaaagaaaaggccaaagatgttttatccaatttagatggatttgtttcacttttgtactagttcttgttgtcatggagataaaggctaaaattcagtgctgcacaatctcaactgatgtttttcatgtacaataccaaatataaattctaactgctgtgctccttgtaaataaccagtgccataattctgaactgtaatttttcagtgctataggatatctccaactatcctttttggtggaacaagctctcaaaattaaatttctttctgattacattaatttgagtttattttgctgcatctgtaggccaaaaagtgtcataaaattgggcaaagaatattagcgtgtgcctctgtaaaaatctaagaattatctgtttaatattttctgtgcttccgaatctacttagacatgaaattgcactcgtagtcattacaaaattttaattattttctgtttcaaacatatttcagataggtgataaagtcttaattaaacataaaaataatattgaaaagtatagtgtgtgagttttgtgctataattaaaatgcagctttatggttcatagcctttgtgggatttgtctaactgtgctgcaagaaattccatccagatgtgaaattctactcagatgtgttcagggagctccatggggcctttaccagctgcatggtgataattttaatctttctccatcacaacagtaaatcagaactttcacattattcagcaggaattcttctgacctcctttaaatggcattaaaagtatacatttagctaatgttttcgttatacaagttctatcacagtcacattaactctctcatgaatgagaaacctgaaactaacatgcaaactttctgattgggaattttaaaatattaataactgtgccttaaataattagtaagaaatcttgttcatgtcttaagaaggtaagcttataaaattggccccttcctggtaatggactttaaaccctgaaaacttactttatcccacctttataaaatcagtgtgtgaaaacaccaaatcttgaaaaggaaggaggtgtgtatatgactatggaaaataaggatgctgttgatttaaagaaagataggttcaagtttaaatgcatttcttttacccgtttattttcctcactgattactatttcttccagaacactaaagatgaataatgcatattcttcttggtatgcatagactgttttaagtttggctcgggggggttgcaccatttggaatcacatctcacccagccttttgactgagaggaggatagtatgaagtcattaagtgcattgaaaatggagccatttcacactcatgctcacccaaagcaccccagtgaagacagattgtttagtgccttttctgaggagcagagtggaagccactgctgactattggagagagaagcacctttggttcttatttctgaatgaggtattccaaaatgaaggggtttacgtgacagcttacagaagtctgtaagtcccatttcgaaaggaaagcaaaaacaaatggtttgtggttctcttgaatcaaggaatcccatgataaaagtgtactaatagtcctagttgatgctgccccaaaagcacactcatgctagtgaaacctgggccagaaagagagcaggttgttcccagttccgatgagctttgtgtccaagaaataagctgcaccagcccttcctggtggttcctgcaggactgggggcttgggagaagctccttgtccagagtgctcatccaggccagcagaggaggctgatcagggacaagttggggagagatggatataacactggctggggaacactaggggggaaaaagccctattttattcttttaatacagttcccagcaggaagatcaggataggaggttctcgcctgctccagattaaaggaacccgcagtttccaggtgaagaaggggggttccttgtccagcattcgccgggtcggcagcttaaagagcagcaagttatcacggcaggactcagagtctgaggctgaggagctgcagctgtcccagagcagggacactgtcactgacctaggtaacatagaggagtggggtgtgcagggacgtggggggtaggaagacagggcccaagtcccaaaagagctgaagtccattttcttacacataaatagatggagggcagagccataggatagacaacctgttcagcctgaaaaccatactacccttggtagagcaaggcagctcaagccttgatgtgcatatgggtcactggagaggcttgttaaaatgcagattctgattcagcagatctggggtggggatctgagattctacatgtttaacaagctttctggtggagccgatgctgctgatttcaaggacgacactttgagcagcaaggatgtggagtattcattagggaaagaaaacactttaatgaaaaggacagtctttgaaattccgatgcttgtgtattcattcttttgatcagaacattcaatgtcaaatgtaattcccttggggaggactacctaaagattctctatattttaaagtctctatttaccagtatgaacaaccaaaatctcagagagtaaagattgtctagacctgacaatgagtgatcttcaacaagtcatttaggttctcagggatttgttttctctgactacacagtgagaataattcttgcctacaatgcaaggatgctctaaagataaattagaagatgaccatacaatgtgttaaacacctgagaatgaaatcagtgtacagtcaaagcatgagagttatagattgtcattgtaggctctaaagagatttcaaataccaaaatatggcagtccaaaatatgggccctaattagtatcttaatagacaagcaaaagattaagtaggcatgaaagtagaactcaccagctgcctaacattaaatattaggtaaaagttgaagcacattcactttgccattcagtctctgtatgcaaggcaaaatagaaagctctccttactaggtaagtagtttcaaaagtcagcaagaagtgtggataaattatcgatcaagtctgctgaaataaaagctgagtatatttaatcaaagaaggtttaaaatagaaaatgcttctgtatccacccaccctcgcctttgaaaatagctgatttatgcattacttaagattcagcttatttcttaaggagacttttttttaaagtatatatgacttctttttttacaagtctgaagctagagcattatcatcagttaatttggggaaaaattattgcaattaattatttaaattgatcgatttatcctgaccaattgagtcaaaatagccaggttgaaaacattgttttgtcattaaaaagatctataaaagattttagatttgaggggaaagctttgttgtgtagtctaccaagtagggaattcttgagagatatttcctttatactttcacacagagaggagtttggacacaagggctgtccacagttggacataattgcttccaaatttccttaggttttcagaggtacctgcccatctttgaaatagctctggtagcaaagcctggtggctagagcaatagcactagctgcagtcacagaacagtggaggcagcagtcactgtgaggcaggttagttgctgtccctccttaaatacacctgcaaggtctggtcagtctggaatggatttgggcgcactcaatcaataactggctcatctcagcaattcaaggacttgactctgtttttttttctctgctcccatctctcaaaatggaagccaccataacagagatcataaatgtctttgaaattgccagttcagctggtggtgaaggggacagctcctgttaatattcctccaacaaagtcaatgctatgccctgtaacccactgggccatggtagtctgccctaggattcagaagcatggacaactgtaccataccaacatgctctccagggagaccgaacactgaaacctttcttggtatttttcttttgaagaagggagtccttggagtgcaagcgagcccagcattgagccagagggaatgagtaatgccggcgcggaggagaattaccacagaaacatgtcgtggcttcatgtaagtaggaatctcagaaacagccctgagatcaatttcttttggcactggggaagatccaaggagggaggacaagagattatactaaatcatcaatccgatctagcctccaagagaaagcaggggcttatgttttacctgaatatctcaacactctctagaattggtattctgctggattgtactcatcttaagcttaactaagaccaagtttttttggttatggctggcttgcaggtcaccataaatcagggaaaatcatgaggccaggttggtggtcaagataacctgagtgacacagcgtaggtatcaccatcagttttaaacaggttactgcgaattttgagagcacggtcatggtgttgctcttgggtgtgtattagatcaaattttaaactggggcaaggacactctaagatggtgaatgtcgtatgtccgagggtgagccagagggcacaggcaggaggtgatcccagggaaactctgggcacggggtggagtccaagacttgagctgagcatgaagaaagaagtaaggagaaaggtaagggaatgtaacctcagttgtacaagtggcagggtatccccaggaccatcacgggggtcaccattcaccctgattttaatctgacttcctggaaaagtcagatgagcactagctggtgcataatggtcctcggatatatggtggctcaccttcactatggaagcagtcaccagaactgactgatttgagaatctctgaggcagctgtttttttaaggtaaactttttagtgaactctaacctacccactgaaaagcatactaaacctatgtatacagctcaatacatttttatgaagtaaatacacctgtgtaaccactgccaggttgagaaaacattatcaacacctaagaaatcctacgcaggtcctctaccagacgctactcttccctgacggtaaccactgttctaccttctaacaccatagattcattttgtctgtttttgaaatgcatgtaattggcatcatatactactactctgttgtgtctggttccttttcctcatataaatgtaggtcctccaattttgttgttcttctccttcacaatggcctggtctactcttggctagactcacatccatttagaatcaccctgacgattttaattaatttaaaaaaaaacttccaaagcagccttgagtgtaatacatagatgaatttaaatgaatcatatctttatgatattgaatcttccaatgtttaaaatggtcgctccactaatgtctgtttctccatttattagagcttctttaaatgtctttcaataatgccttttagttttctgtgtagtgttccataaataaacacctctgcaagcattgtgtaagaacagtgctatttcttctttaaatatttggaagaaatcactggccacgccttttaaacctaaaaatttctttatgggagagttttaaattacagattcagtttatgtaatacagctaagaccatttagattttatatttcttctgggagtaattcaggtaaactgatattttttgctaagattttttcatttaatatcaatattcaaatttatcagcaaaaagattgtttataatattctgttaagatcattttaaattctgtaggatctacagtgatttacatttattgtttttgatattggtggattgtcttctcttcttttttaaatagtgtctttctaagagtttttcaattttgtcttttaaaagacccagaaccagattttcattttgtcatttttagaatgttgaatttttgttttactaatattttctattatctttattactttcttctactttttttgagtttaatttgtttttgtttttttcttaacttcttgacacggatactcagatgattgatttgcaaccactttgctaacatgaatttaaagctataaatattatctagaagcagttttagctgcatcatgcaaggttggatatatgttcatatcattcagttaaaatattttaaaatttccattgtgatgtattcataattgatcacagattttttaaaaaaaattatttttaatttttgggggtacatagtgtgtatatttgtggggtacatgaggtgttttgatacaggcatgtaatatgaaataatcacatcaagaagaatggtgtatccatctcctcaagcatttatcgtttgtgttacagacaatccaattacattcttttagttatttttaaatgtacagttattattgactatagtcaccctattgtgctatcaaatagtaagtcttactcattctatttttttgtattcattaactttccccacctctccctcaaccccctactacccttgccagcctctggtaaccatctttctaactctctatgtccatgagttcaattgttttgatttttagatcatcccacaagtaagtgagaacatgtgatgtttgtctttctgtggctggcttatttcacttaacataatgatctccagttctatccatgttgttgcaaatgacaggatctcattcttctttatggctgagtagtactctattgtgtatatgtaccacattttctttgttcattcgtctgttgatggacatttaggttgcttccaaatattagttattgtgaacagtgccacaacaaacatgggagtgcagatatcatgatcaagtccacagctgataacttcaatatatgaatctattttctttactcttcttggtcctgctcctaaaatgccttgtaattatattgactaaacatggtgtataaaaaaaattatagaggtgcagtggtagatacatgtcattatacatttgttaaaattcacagaatgtacaaagcaaagcgtggaccctaatgtaaactgttgactttgggtgataatggtgtgtcaatataagttcattgattgtaataagtgtaccactctgaggcaaggtgttgatagtaggagaggttgtcatgtatgcagacagtgtatatgtgggaattatctgtactttctgctcaattgtaatgtgaagccaaaactgctctaaaacataaagtttattaatttaaaaaaaagcaccggggctctagttgatgttttctctttccagagaggattcaccctgtcctctggcagacaacaaagaagcagatcacctcagtccagtcagggactatactagctggacttggactatttctagcctgtccttccacaccctctacacacaccttttaatatgaagatgtccaagactcccagtgagagtctggggtatgtcacagggcctctcattcttgatgagtcaggaactacaatttgtgtttccccatcacaatgaaatttccaaagtctctactctgtttgtcagctggtctttgcttctcttcttagctactcaatcagccaatgcctagaagggaaaactgtcatccagtgtcagtcggacttatttggacctcatttctctacagggactagactattcagtttctcccttctttggtaattccaaattctaatttttacctcctagcccccatgagattgcctaaggctctgcctagcttcttggccagttatgcctaagatgtagcaaatgtctcaaggagaaatgtgatgtgtcctcacattgtcctcacctcagcgaatatcctttctctccacatcatacccttcatcctgactgcctcactgtcttatgcattcaaatatgtatatttatgtatcatgtctgtgtgtatacaggcatacctcattttattgtactttactctactgtgctttggagatatcgcattttttacagactataggtttgtggcaaccctgcattgagcaagtctgttggtgctgtttttctaatagcatgtgcttactttgtgtctctgtggcacattttggtagttttcacaatatttcaggctttttcatgattgtcgttttttatggtgatctgtgatcagtgatccttgatgatattattgtcgttgttttgggacaccatgaaccacacccatattgatgttgaacttaatcaataaatgtgtgtgttctcattgctccatggaccagctgcttcttgtgtctctccctcttctagggcctccctattccctgagacacagcaatattgaaattaggctgattaataaccctacaatggcctgtaagtgttcaagtgaaggaagagttgtgtgtctctcactttaaatcaaatgccataaatgattaagcttagtgaagaagatatgttgaaagccaagatgcactgaaagttaggcctcttgtaccaaaaagccaagttgtgatttcaaaggaaaagttcttgaaggaaatcaaaagtgctactccagtgaacacacaaacaataagaaagtgaaacagtgtaattgccgatatggagaaagttttagtggtctggacagaagatcaaaccagccacaatattctcttaaacccaaagcccaattcagagactaggttttaactcttttcagttctgtgagggctgagaaaggggaagaagctgtataagaaaagtctgaagttagcagaggttgcttcatgaggttgaaagaaagaagccatctccataacataaaagtgcaaggtgaagcagcaagtactgatgtagaagttgcagcaagttatccagaagatctagccaggatcattgatgtaggtggctatactataaaatgatttttaatgtagaagagccttttgttagaagaaaatgccatctgggactttcgtagctagagagaagtcaatacctggcttcaaaacttaaaagaacaggctgattctcttgttaggggttaatgcatctggcagcttgaagtttcagtcagtgctcatttgccattctgaaattctagagcccttaagaattatgctaaatttactcttcctgagctctataaatggaaaaataaagcccggatgacagcccatctgtttcacagcatggtttcctgagtatgttaagtccactgttgagatctactgttcaggaaaaaaaacaaaaaaaaatttctttcaatagattgctgcttattgacaatgtggctggtcactcaagagctctgatggaagtgtgcaagaagattaatgttgctttcatgcctgctaatgcagcatccattctggagcccacagatcaaggtgtattttgactttcaagtcttatgatttaagaagttcattttgtggccaggtgtggtggttcacacctgtaatcccagcactttgggaggccgagacaggcggatcacgaggtcaggagatcaagaccatcctggctaacacggtgaaaccccgtctctactaaaaatacaaaataaaattagccgggcgtggtgacgggcacctgtagtcccagatactcgagaggccgaggcaggagaatggcatgaacccgggaggcgaagcttgcagtgagccgagatcgcgccactgcactccagcctgggcaacacagcaagactctgtctcaaaaaaaaaaaaaagtacattttgcaggggtatagctgccaccacagacagttatagggattcctgtgatggatcttggcaaagtaaattgaaagcttctggaaatgactcaccattctagatgtcattaagaacatttgtgattcataagaggagatcaaatatcaacattaacaggagtttggaagtagttgatgccaaccctaatggaagactttgaggaattcaagacttcagtggaggaagtaactgcagataaggtggaactagcaagagaactagaattagaagtggagcctgaagatgtgactaaattgctgcaatcttatgataaaacttgagtgggtgaggaagtacctctatggatgagcaaagaaagtaatttcttgagatggaatctacttctggtaaggatgttatgaacattattgcaatgacaacagataatttagaatattacataaactaagttgataaggcagcagcagggttgttgagggttgatcgcaattttgaaagaagttctactgtgagtaaaatgctatcaaacagtatcacatgctagagaaaaacctttcatgaaaagaacagtcaattaatgggccaaacttcttcattgtctaatttaagaaattgccacagccaccccaaccttcagcaaccacttctctctctcatcagtcagcagccctcaatatcaagaccctccaccagcaaaataaaaattataacttgccaaaggctcaggtgattgttagcatattttagcaataaagcatttttaattaaggtatgtacattggttttttagacatgatgttattgcacacctaatagactatggtatagtgtaaacatgatttttatatgcactgggaaatagaaagattgtgtgactcacttaaatgcaacatttgctttattttggtggtctggaactgaactctcaatatctccaaggtatgcctgtatacacgtgtgtgtgtgtgtgtgtgtgtgtgtgtgtgtgtgtgtgtacagtcatcccttggtatccatggggattggttccagggcctcccatgaataccaggatacacagatgagcaagcccctggtataaaatggtatagtatttgcatataaactatgcacatcctcccacatactccaaatcatttccagattacttataatacctaatacaatgtaaattccatataagtagttattatactgtattgataatgattcccaaaaatgtctgtgcattttagtaaaaacaaaattttggggggatattttggaatatttttgatctgcagttggttgaatccacggatacagaaaccatggatatggagagctgacttatgtgtgtgtgtgtatatacaatatatatattatattatatgtgtgtgtgtgtgtgtgtgtgtgtgtgtgtggacagtgtggactccctgcaggaaattgtgtatatatatttatatatatattatatatatacacattatatatatttatatatatacacattatatatatttatatatacattatatatatagtatatatgtaatatatatattatatatagtatatatgtaatatatatactatatatattatatatagtatatatgtaatatatatatactatatatatagtatatatgtaatatatatatactatatatatagtatatatgtaatatatatatactatatatatagtatatatgtaatatatatatactatatatacacacatggttagagggggaatgtattaattttctagtgctgcatacaaattaccacaaatttagtggcttaaaacaatacacatttattagcttatagtctttatgggtcaggaattctggcacagcttagctaggtcctctgctttaggatctcccacatggctgcaatcaacatattggccttgcccacatcatcttgctttgtgctctctttgtgttcaatatggaacacagtccctcaccggttagttgttaaggtgggaactattatagtttcatgaaggatggaagcattcagaagatactctacacactattgactgaccttgtggctctgcatatgctattgccttttaagaaaagctccttaagaagttccaaatgcaagggcctttattccttatcttaaaataaccatatcctttaaatcaaatgaattcccttctgtaattttaatgggagaattataggagatgtgaggatttgattttgatttagctacaagagaagagctaggatgttctaaaagccagaggaaaaatatcactttgcagagagtggaaatgaaactgtacagtaaggttcaagttctagttgaagatgattggccagaggagaagaagtggaaatgttttcaagtcccacatgggtgggctggcattaaaggtgtcccacagctgtcaaaggtcagccagatcctctgggacagaatttctcaccagtctatgccctttcatatggttccttccccaatataagagctggaaaaaaatttagttttaagttcagaatctccatttgagaatatttggaaaccatacactccacaataattgttttaagtttttgaagacctgttaaccttttaatgtttcaaagagatccttctatcaagtatgaatggggggagaacaaaaggccatgtggataaagaaccctttgtcctcctttgggaattattggaccattgcgatttcaagacacatccagggaagctgacattctgacttcccatcttccaccccatagatatgttcagtttatctgtaccctggttgcctggctgagtctcaggaatgtttgtattccaggtgatgatcttgctgtgcaatcagcagagtttcatctgcactcacgttgactactgccatccccactgctacctgcaccacagccgctcctgtgcccgactggtcagagccatcaagctactctatggagacagtgtggactccctgagggaaagcagcaacatcagcagtgtggctctccggggcaagaaacagaaagaagtaagtaaatgaccattgaatgatattctaatactagaaacatgatgtcataacaatttcttctctggaaataagaattttcaagcaaatgcaattgtaacaatcaggtctgtgtgcatctaaacataagcagaagagatgtacaagaaagacaaatgttttgtctttcttgtccatgagtaaacatggaatctttcctcaggttttgtcttattctgtaaataaatatgactgcatagggatgatgacgatgacgaataagttattgtgttaggcagaataatgcctctcccacaaagacattcacatcctaatctctggaaattgtgaatatcttcacatggcagaagaggttttgcagatgtgattgaaaattttacagtgggcatccagctgtgcttgatgtcatcataagggtccttataagtggaaaaaggagtcaggagggtcagagccagagaaggaaatgtcttgagaaaagcagaggtcagtatgatgcggggccatgagccaaggaatactggcagcctctagaagctagataagacaaggaaatggattatctcctagagccttcagaagcaaccacagccccgccaatccgttttagatttctgacctccagaattgtaaaataataaatttgtgtcattttaagctatgaaggttgtggtcacttgttacagcagcaacaggaaactaatacaactatgtactaaaaaatatgcataaataggcccactgttcacagccaagtaaaagagtcatctaggtcaaatcagactaaaggaaattgcttcaagcaactattacatttttcaagtattcagctgccctcttctgaaaactaccctgagcagctgagctggcaggagatgaagacagtgaccagggctgctgtgcttctgccagggaaggcctaaattttccacctgcccctgaacaggcgtcacagccaagatgcctgactgaatgttgtggctgcccctgcagctgcttttcctaagtggttttgcaaagagatttttatataacacctattcatttcaacgggcatttattatgtgtcctctgttggcacaatattaggctagatattctgttaaggaaaaaaaaactagaagcagaaaatctttctaaggaatttgcaaaccaggtttggcctggggagggggtaagagataatatgtacatcaaacaatgagagaacatgagcaataacaacaaaaatccagttgagtcgtgtagcaatttgttataccttagtgctcacaaagggatttttttaattacaacttttttattatgaaagcaatacatgttcattgaagaaatttttaataatacaaaatattctttaaaaattatatatctgatgtacctcttaagtgtgcaagttcatcctatggggtatgatcttttagtttttttctaaatgtatgtgtgagggtataaagtaagtacatttcattgacaagtgccttttgattcttaaaaaccattgcaagagttattttatccccattttacaggtttttcaactgtgggggctcagaaagttgagattatccacactttatatctataatgtatttagctagactttaaccttagaaatatggaacatcagagtcagggctttttaaactagactgttttgcatttcatgttatgcaaataatacaaattctgaggggaatgaaggtggagaatagaccaatgtggggtacaaataaactactaaataatgacataaaaagaaaaaaagtaaatacgtttgtgtgtgcatacatgtatatgtatatacattgtatatatatttcaaacataaatgacactgcatttaaagaaaatctatttttatttatgtaaattctttcttactataaaaactcccttagctttaggttaaaaccatatatgttgaaagtttcaaaaatatgtgagcctaaattattgatcattgttctccatacacacttcagaatttcttactgctatattttttgctggcactaggcctctaatctaacatagcccaacccaaacattctttaagatccaacttaaatgccatctcctccatgaaacttttttgattcttcaagtgttaagcacagggcctactgcagatggacactaaatgttattttccttacttccttcttcaactaaattataattgtattttactcatgttttctcattcttctttcaattatccatccatccatccagccagccagccgttcatctattcaacaggcttttaaagaacctgtggaccatgctgagcccatactttgcgctgggtacaataatgggcaaaaaaaaaaaaaaaaaaaatacagtttgtacccccatatactgcacataatctagtccaagacagacattgatcaaataaaactcccaaattgatgtaaaattacatctgcaataagtgaaataatggagagctacaccgtgctaagagagcttatgaatgaggctttggtcttgtaggggaaaataaaagacagcctttccaataaagtgacaggtgagctttaactaaaggatgcatagatgttaattggatacagatttgccaaccagcgagaagaggtgagtatgaagggccatggctggagcacagaggactgtgatgcatgatgaagctgcacaggcggctcgagaccagaccatgtgggaccatgggaaggctttcattttatcctgcgagcagtggcatgttcttacacttaattataagctttttgagaactgaggaagtctttcacattttgtatcctgcatgataacctaacagagtactcacttatgtaatagtagagcagttattaatattaagtgagtgagtagagctgtagtcctagggtgtttcatgagtgccctccactctgcctcaaccaggcccctggcctgaagcagtagaaaaagcttaccaaccttctgctattgcttacatttctgaaaaggaaagggaaagtaaagcatgaataagtgcttctaactttaacatattgtaattagtcattcaggtagagagctaaaaagatgaattgactcctctgtgataaacattttatttgcaaaatgctagcctcctccacaagctctttgctttctctcatgatacttttcatttgcctgttgtgaatctgccagataaatgaacagtgcccacatttccagatgaaaaatgaaaacagagtgggcaatgaagcaagagtaaaagcagtattctgaataaaatcgtgtcttatgagcaattgatatttcattcctgttttctttttaattggttttttatggcagagtatatttgtggcagctagtacattttgtaacccatctaattctgatcaatttgctaatctacatttcaatgctgagggactcactgtacaatctgttagtctattttagtgtacttccaaaattgagggtttttaaaaaacaaaatgtcattctacatgtatatatcacctttaccaaagaattctgagatttttcctctatgtctgtactttgtccaaagctatgttataaataggataaatgtttaattaatgcttgttaatttaaaaaaggagcagattaaattctttcctctttcaaccaaaaaggagagaggaacaaattgtgatacatgctcaaaaaaataaaggacacagtgtgggtaaattccataaagcaaattccagtgcaaatgtcaagaggtcaactgacttcctgcagaaccaacatttttcctaaagctatctatgagcaacattattgtaaggccaagaccaggccctggatcttaatttcatgggccaggatgactgtccactataacttacataattcatgtgttaaagccgtatgaggcataaagagtctaggttaccttttgagaaatactgcatttctgttggcataaacttcttcccagaaacgaggaaatccctttctcagagagcccagtaggctgacttcaatttccacaaattttaaacaccttattacagtgttacaattcttttagaattaaaaaaagaagaagaaatatataaataccttgttatttccacactgagtcctccttcatgcatgcatttccttttctatttatcttgacttttcatttgtttacttgtttgtcatctgtctttcctacacttctctaggagtgcaggcacctactccagaagttagtctagtttctggcatatggttaactcaaaaaatattcttgaattattcaatgaataggcaaaattttatttaaaaccattattattcctctctagtcaataatttttgttgtaaggaacagaagattgaacttgttcaaacaattagggagattcttcaaaggatacagtagaatctcatgaaactagggacaggaaaagaaacagctaagcctcagggaaatgagaaccaaagctgctgtccatttcaggatgaacatagtctttcatctctgcttctttccgcatcatctccatctgcacagacattttatcccctggccagctcctattgctgtactcatcttgtacatagactgaaaatttcaagatggcatcattatttttctgcacagcaaccatcactaaatgattcagactgtttctcttaattccctaggacaggaatttgagggggccatctcttcctcttttgggccaaacaccacaagtgataaatccttagccagtcaaaaaattggttttgcattggtaatctaatcaaaagtggtcaggatgccgagaggagtcacagagtcaactaggatggatttttctaagacatatacataggaaaaaatgtcattggtccaagttctaccctatcccatagcagggattcccaagtatccctgacagagcatgaggctgcataactgcctcccattgaacacagctccctctggtagaaccacctcaacaatgactgagtagaggaattaatcactaatttatcaataccaaaggacagaatttatccctaatctctatttatcactaatagaggcatctactagtggtcctttgaagagtttgaatttcactgaactgcaagatacacatagtggttgaaattacacatcaagcagggaactgtagagaaactcaagactagtaacccaagaccaaaggacagaatttatcactcttgtttccagaatttatcactattctgtcctttggtcttgggttgctaatcttgagtttctctacagatccctgcttgatgtgtcatttcaaccactaggtgcatcttgtagtccagtgaaatctctaactcttcaaaggaccactagtagatgcctttggaactagtctcctgctccttccagtagtctgagttaggagtcacaccaatagagggactttaagacctttacaagagtgtacccaaacccatcacacatatacccccatctctgtgatatctatcttctaatcaagtcattaaaaaagagttactagcttatcaccttgatgtgaaagcccttgcagcttccttccttttccactaaaacaagcaccctaagtgtcatgaggccaccagaacacaccatgcttcctaaggtaacatggtaggatattaaatatttgaggaacttgacttatactttggtaggcagaaacacagggtatcagggacaaatataaatgctcatctttttttttttttttttttttggtgtgctgagtattttcctgtatctgcctggttaaaattcctgtaatttaatcaagaaatattattcaaaagaattcctggagaaaaaatgtccaaccaaaagagaaagtggtaaaatatttgcaaaatttaagaatcatattttcaaataattgtaatggaaaaatactctttataaaatcatagtaaaatgaatcatttaaaattgtgtgccacacatagcatcatcacagttgtgctaagatgcatgggggaaaaggctgaaaggaacctaataatggctatcattgggttggggattgtattagtctgttctcatgctgctataaagaaataccctagactgggtaatttataaaggaaagaggcttaattaactcacagttcctcaaggctagtaaggccttgggaaacttacaatcatggtggaaggcagcccttcacagggcggcaggagagagaatgagtgcaagcaggggtacatttattattttataaatataaataataaaacagagaggtgccagtttttagtatcttgactcttttgcaagggtcagatacacctccatattaatgtggaaaactattgctatatatgattttagaacagtcttcaagttatataaaatgggcatgctatttatgctatatattgctttcacattcacaggggaaaaaagcaaagcaatagttatctccccaaataatatgtgttcccacatatgcacctccatgattttttctttagaaagcacaacaagagccctgattcacttgttttgaagtaggttcattttaaaagttggttctatactcgtcacataatagatgcattttcttgggtcgttttgtcagagttttgaaagactttcttggaatatccatgcacttttagatttgccttttctttcaaaatatctttatccataacactatgaagctctgttcaaaaattcttaagaagttcagttttttttcccttggctagagggagaaagtgtttcactgacatggcactggaaaaacaaatgagcatttattctgtttgaggagaacgattccctctttgcacagcctggagtgcaaaaataggaagaatcaggactctggataaataagcctgccttcgttaggttcagtccttctcccagctgcattattcagtccatcccttggcatttaaggagttagaggaagaaattgtcttattcgtccttatgtagatgaatctcctggttgaggagacaatttttaagaagagctgctgcctcttacagaagagtatggtttttgaaaagaaatcattttacctgtacaactcagtccttgataatggatactatgaactcatgcttccttgatgggtcctgtatttgacctttaacttcctaacacttctctatgaaatgttttctctcctttatgaccaagtcattcaacttgcagcatccaaccctatgaagggactattggatagagtggattttatctgactaaatattttaaaagatttgtgttttttaactgcttgatgaaatataattagccctgaaatggaaatggggagatccttgtcctttcctttttctgctgataactagctttgcaactcagtcaagttcctccacctctccagatcccagtttcctcaaaggtcaaagaggaattcattactcaatatctctaagctaattttttattataaaattaactgcttttataaataaactgcttttataaattttagaaaatgtggacccacaaaaaggcctttaattatcgcttccactagaagatggttgcctggagaattgcggggacatatagcactgttgggtttttagaaaacacatcactcttcattacatatccctggtcttttcagtgctcagataagtcatgcctgaggacaccttctctaaagaagagagtttcagatgccaatctggaaggaaaaaaagattccggaatgctgaagtacatcagacttcaggtattgttacctggatcagaaggattcatggaacttttaacagggaggggactccagacagcctatttactaatgtttgggacatacaacatcagttggtacagtgttggcataaagccccttcagttggtgagcaagagtgccaccaagtgtgccaggaaaaaagaaatctcttcttgctatatagccagcttccacagacaaggcttgggaacttcggttcgaaccacagctctccccactgtcttcactgcaggagagctaacttcccacatgtgtgtaacagtgacacttacgggttttggaatgagacagtctgggttcatatcccatgtctgctgctctggctctgggaccttgggcaagttatttaatttctcttgatcttagtcacctcatttataaaatgggggttacaacactagacctgtcccaaggaattatggcatggattaaagaaaatggttcatgtacctacttatccagtgcttgacacattgttatattgttattacaacatgagctctaaatcattatgttctcccccccaaaaaaattgttcatatttttctggaatgtgaaatgatgatgacttgtctagaacctatatttgtcacccaaattgtcagaaataatggataaaggattttgtggtttaatctggggcaataaccacaatgtattatgtatttcaaagggaaatgccatgcatgttcacaatgggctttttcatcagttacaggctgcttatagtttttggtggaaatctactattaggaaggaaaacaggatcctttaaaaatctatgaagacttttaacacaaagatgtatttcctggagtctttcttttcttgtggagttgtactcaatatatagtttactccttggtcgcaaagcaattttgtggtgaaaacgtcataaaattagtgtatttttttctaattatgcttcagttataaggtataaagcttatctatcatatgccatgtcaactaaatatgctcccattttagaaagcattttaaggtcacttaaggcaagcagagagaggggacgtggcttttaagtttcaagagaagtgcagtattcactgtcttaaaagattttaaaacatgatttccatcttttcccaggtgatgagcttgtcgcctgctcccttatctctgttaatcaaggcagcaccaattctgacagaggagatgtacggagacatccagccagctgcctgggagctcctgctcagcatggatgagcacatggcaggggcagcaggtaaagaaagaccacctggaaccctgtgcctgctgccactgctgttactgatccaagtgtttaaataagagaggtgtttccattctatttttgctcctaggtcaagttaatggcaattgctataactgtagactctagagctgtgtgctataggaaggtagacccagggtttgtgtgctcccttccaatttcaccatatggtctgcaccatagcatatgtctctctcagggtgttaccaaattatagagaatgattttccccagatcctgcactttcactatatttcacaagagacaaaattcttttttgtgtcatctcctagatttaacatgcaccactgtaatttactttatcaaatcttatgtgagtaatgttctgtgtccaaaaggtaatatcaaagcaaatgtattaaaatgtaagtgatttgtccaaggccacatagctagttagtgatagaggcaaaatgtgtattcttcatttttccactttttatacagatcgctaaatttgtatctggttattttaatttcaaaatacacgtgataaaaattcaagtaatacaaaattgtatgaagctaaaagtattgccctctctcctatgacccgcccccctctccccatcccccagcccccttccccctcccagcaccattcctttccccagaggcaacaatttttaagtttctcaggaatccttctagggtaaactgtgtgtgtgtgtgtgtgtgtgtgtgtgtgtgtatataaatacacacatatatgtatgtatatatgtaagttgtgtattgaatgttttgtttttcatgcaaatgggacatgctgtaagtgcactttgaattttttcatttatatctagaagactgtttttaaatatcagtttatagttttacctcttctctttttaatggctacaaaatgttccactgaatgaattgacatattgtaatttatttaaacaagatctattgatgaaaatttaggtggagttcagccttttgctcttttataccatactgcaataaatatcttggtaaaatatctttgttcacattaaagcttaggtttttgcttctcagagagcgctgtaggagttcagggaatggcacactccccaaatgtgggatagtcatggaaacttccatggaaaatataaacaggtggacggggctttaaagaacacctagaagttagccaggaagggaagatggtgtgtgcaaaactgggaggccgaggcgggcggatcacgaggtcaggagatcaagaccatcctggctaacatggtgaaacccatctctactaaaaatacaaaaaaaattagccgggcatggtggcaggcacctgtagtcccagctactcgggaggctgaggcaggagagtggcatgaacccgggaggcggaacttgcagtgagccgagattgtgccactgcactccagcctgggcgacagagtgagactctgtctcaaaaaaaaaaaaaaaaaaaacaaaaactgggtgaatgtggacgtgcactgggctttttggaaagcctgaggagactgaaaactaacatggctagcatggcttttgtagaggggtcacaagtccataatattagaaaggtgagtgggactcagcttgtaaccgactttgaatgacaggcttatgattgtggaccttccactgaattgtgaaaaaccagtggtggtttctgagccatacagcaatgttgtatacagagtgtgaattgttactaagtttgatactgcagcaatatgtggaatactttggttttaaaaatagtgttttgttgtagaggaaggatgaggagaagttggctaatgggtacgaacctacagttacataaaaggaataagtcctaatgttcaaaagcatagtagtgtgactatcgttaataacaaagtattgtatattttaaaatagctagaagacaggacttgaaatgtttccaacacatggaaataataagtactcaaggtggtggatattttaagtactctgacttgatcattacattctattcatataacaaaataccacatgtactccatgtgtacaaatattaagtgcatatttttaaaataaatttttaatttttttcaaaaagaaatagtaatttttagatgaaggagagttggtaatatatgattggtgacatgacactgaaactaaagaggaaggccaaagttagaggtaaacatggggaacaagttggtatacatggcagctgaaatagtgagagtagatgggctctctgggagagggtcagtagagaagaaagagatgaggagtgaccactaagccactggtcttctccacatctagaggaccagaggaagaagcccagccagaaaaagtgatcagaaaagtacagaactcaaataatctcaagctgtggaagcaaaggaaaataattcttcaaggagattatgaaggtattaaaaactgaaaggaaacaaatggtatacaaataccattggatctgaggattcgtgagcattacaagaaaactttttcagtagagattatgatagaactctgcagtgacttaaataatgagcctagtgtttaaaaattgaggcagggtgggtttcattttaaagaaaagcaaggaaaggagaaagagtggagacttaaacacctagtaggctaaagaaaagtattatcaaaagataatgattacaataactagcatttgttatagaactagatcatatgcattatcttattgataaaccattctatagatgagcaaacttgagtcagataattgaaaggacttatctaagttcacacagctcaaagggcaaggaaaccaaacccagattttctgactgcacagatagatgcccttcccattacaactacattgcctctatttttaaaaaacaatatactttagaaatgcgttgtacttttcacttcacaaagcactttctcatatattcttttattttattctaaaaacaactttggaagcaggtattagtattatcattattgttcttattgggaggttcaccagtaaagaaaatcgcaagctaagagaagttaagaggcttgcacaagatctcatggcagagaagtatcagagctactaggatttaaccccatttcttctggcacaactgcctaagcacattgttaggatctgtgaaagagaacatgagagattcatgacatactcatgtagggtatgtttttataactgccactggctcctctatctgtgttataaagtgtatttataaagctcattattcattagctttataacctatcatggaacctggcctttcacttactgatatttggcttttcacaataatttttcatggtattatgactcattaaatctcttttggtttctcaacctcttctatctctgggaaggatatatgtttctaatagagcctatgatgtggaatttttaaagtgtagctaatgtaaatgaggtagtttttaaaggataactttatttattgtcctcgggttactaagagatgactctggctatctcctaaaaaacatatttcaggatgtacttttttaatttcatttgcttcctctggcattcacttttcactgtgagtcaaaggaaactttgcttagagtgagtgattctactgaaatgtcatgttgttgctgccctcgcaccagctattggaaggttgtgggtggtacaaagaaggtttgcttttgccagtgctggtagcctagctccatatagctcaggagtcattttcagaagatagaagcagtttccacttctccccaaccccaggaactaagcaatattttaaaagcatagctgatgaattgttgactgtctctagctgccatgttcctgctgtgtgcagtgaaggtgcctgaggccgtgtccgacatgctgatgtcagagttccaccacccggagactgtgcagaggctgaacgctgtcctcaagttccacacgctctggaggtttcgctatcaggtctggccccggatggaggaaggggcacagcagatttttaaggtgagggatacttctcacagaggagttacattagcaaacccaacccaaggtttgtttaaaccgttgaacctcaaagtcacagtatgtggccaaagatattcttcttttttctctctgatcatataagtaaacctaacatacatgaatgcattcctactgttaaaaaattaaaatatagaagaatatagagtaagaaaatcaagtctctataaacctcaaaatctcaccagcattcccagaggtaagcatatgaaagtctggggaattatcttctaaacattttgctatatataaacttacaggtatgttttggaggatgggttgataaactcaaatagagatcatttgattgaaagcctttaatgaattagtaaactgaggcccagataggttcatcttgtgctctataacagaaaatcttggcaaatagcccttttctaaaattcttgttcattctgtgtgaagtcacttggatgattaacacttcctgagacagattgtgtcatcattatacttcagcctcattctagcttatattccctctcacctaatttttctgatgtcaactaacagattccgcctcccagtatcaatttcacccttccctcgccggtgcttggaatgccatccgtcccaatgtttgacccaccgtgggttcctcagtgcagcgggagtgtccaggaccccattaatgaagaccagtctgtgagtaacagacacttccaggttccatggtgtacgtgtaaaagagaacaattaatatttgtggtaatttgttcattctcatcataagaatgtaataataacacagaaagtcagcacaaaagatctttgtccttgtgaatataatagagagaataatatcgagtagtgagtacttgcagatctcaaaaaaaaagtcttgttttataatcaaagcagaagccacctttaaagctactaaaagcattaggcattgatttcttggccaaaggtggcccttttgcctctatttattacaaacgaacatacttatttaaccaataatacacaagccaagttaaggaccctggccctgaaaaaaataagaaaaagaagagagttggcagctatttacttgtttgaaccttagtttattcttcattttgttgattatcagtgtcatcatcacagacatcactctgacacccctgctcttattactgctatatgtaatataactcataaacggtcagatttagaacacagtccatttatagacaaaaaacaagaatatgcaccttttgaaaaaaattcatcttcagaatatgcctttttcacctgtttaatagtatttttctaaattacaagagtaatgtagaaaatttggaaaataaagcaaaaatagaaaaaagaacacctctttgcacaaatttatcattgtttccttgcataaattcctatgggatttatggcaataataaaataataaccattaaaggtttttgacgcatctcacaaaatatccccagaaaagttatatcactttgtccttatagaatagaattgaaaagtatcttattaactagtgttattattttaattgccactttgaatggccaaaacaacttactgtttattttattcatacttctttgaaaaatttagttgaatatatgaaattagtttgaacatctttgcatattactcatagtatttctaggcatttgtcgctttctttggagaactgttttttaaactctttcccatcacaatatacctattttattttaattctaccttcatatctgatggtaccttgccaaagagaaatacacacctggttcttctcccatatgtgcagtaatttcagcatctgaaccaccaacataaagttatctttgatttttctcctgaagaggtggtgggttcatctgagccagccacaatctgtatcccaagctcactgtggatttgaaatcaagtaccttgattttatatccagttatctttctcattccacagttcttaccttatgccttaatataataaaccagcttagctatctggctctgaaaatggattgtactaaaagttcaaaaattagctgggcatggtggcaggcacctgtaaacccagctactcagcaggctgagacaggagaatcacttgaacccaggaggtggaggttgcaatgagctgagattgtgccattgtactccagcctgggtgacaagagcgaaactccatctcaaaaagaaaaaaaaatgctcttaattgctactctacctttcaacataggaaacctttagtcttatgttaagatcctccataaagggattatctacaaatgcagccctgtagaagagtaatcaacatcccctgcctgtctcttgaaccctgtgtgactataagccaacaaagagttctggaattgccattgtgcataaacattacttcaagtggatagagaagaactccagtgatcacttccctgctcagaggccactgactctgtctccaaagctcttggagcttgtctgggcataagcatcataattaagacatgaatagaatagctgttgtacagtgaatcttcttttcttcattgttcctgatccttcatctatggaggagtgagtttttcttggtatttttccagtatgccttggctactgttaaatagagtcagattttacattcaaccttagtaacactatcagctctcatatttttcattccataactttgtttccacaaatattattaagtgtttatagtgtgacaaatacttgagctacagaaatgaaataagccatataactaactggcttatatgagagatctctctttctttgtcctttccatgattctgactttcaattttattaaccttatgaaataaatgttcttctttttttttttttttgagacagggtctcgctctgttgcccaggctggagcgcagtggtgtgatcccggctcactgcaacctctgcctcctgtgttcaagcaattctcatgcctcagcctcctgagtagctgggattacaggcttgcgccaccacgcccagctaatttttgtatttttagtagagatggggtttcaccatgttgctcaggctggtctcgaactcctcacctcaagtgatccacccgcctcagccttccaaagtgctaggattacagacgtgagccaccacacctggcctgaaataaatgtccatttaaaaacagttcaaaacattctagaaagaaatagagtacttaaaaattttatttgatcataatatttaaagagcaaatcattgatatccctgcaaatcctgagatgaaataggattccttccagaaattatgtgttcatgaagaatcattctgattgaatgaaaaaaaaatagcttaaccatacacagcttggaaatttggtaaaaggacaaatatccatgaaactggatcatgggtatcctaacatttcctgaggacaaactactacgtttgtgtcattcattggaacactctttatgcctgtgaccttgcagaagaattgctattaaatgaacttgcctttatgtctccacagaaatccttttcagcccgggctgtgtcccgctcccatcaaagggcagaacacatcttaaagaacttgcagcaggaggaagaaaagaaacgacttggtagagaagccagcctcatcactgccatccccatcacccaggaggcttgctatgagcccacatgcacgcccaactcagaaccggaagaagaaggtgccctctgcacacaggacttcttggggggctgagtctcagggaaataacgtgctctgaaattaacattgacaattttatgtgacatgaggtgatatgcccccttccatctctctctcacttcctgacgctaaccaaagaaagagaaaagttgttttctgaagtttagagttagccattttcagaggaggacattagttacattaaatgaatgattcagggaactgctgaatccagtatgtgtattaaagtaaatgcaaccaatctttcattaactactttcaaccttcacaagtgcagtttgtcagttggtatcaaaaatgattaattaatcattctgaattgagtgattctctgtcctgcttttgtaaaaacttcgggggatattttctgtctttcctctgtagggcttttttaatttttatttttccttttctaagtacactcaaaattatttaagccttatggtctgagagcagtatgcatttgtgatacaacaacaatgtgataataataactcttttgttataaagccaaagttcacattccccattttgtttgccagtagaagaagtcaccaatctggcatcccgtcgactgtctgtgagtccatcctgcacctccagcacttcccacaggaattattccttccgccgcgggtcagtctggtcagtgcgttcagccgtcagtgctgaaggtgtgtcctcttgcatacgttttatttctcctgacttatgtgttttgaaacactttccagttaatatcatgatctcacttgattacattgtcttcattaaataacttgtctcatgacttgacattctaaaaaaaattagcatggcatcctttaaaaaaaaattgttgatttacctcagcaattgttatttttaagttggctctattttaattacattgcatgtaatcatattgctgagggttcagaatacatcattctagacagttaatagttctccacctagctacagtacattacaaccaactgggaagcttaaaaagaaagttcctaagaccaaatcaaaatctctgagggtaggactcatcagtgtttttaaaacctcctcagctgatttcagtgtgtgtcactagtttttgtttttgtttttgtttttgtttttgtttttattcatccctgtgggtataaagtggtaactcaatgtgatttttatttgcacttccctaatgacaaatggtatggagcatcttttcatatgcttattgaccatatgtatatcttctttgtaaaagtattcattcaaatcttttgcccactttaaattgggcaatttgtcttttaactgttaaattataagaactatttatacattctggatataagtcacttatcagatatatgatttgcaaatattttctcccatttcgtagtttgtctttttactttcttcacttgatcttagccaaaaggctgagaagcgagtgtcttttttattttcttaaaggtaactttgaggcacaaaattttttattttaattaggtccaatgtgtgtgtttttcttttgtcatttgtgcttttagtgtcatatctaagaaacaattgtctaatccaaggtcgcaatttgtctaatccaaggtcacaatttgtctaatccaaggtcacaaagatttactcctatgttttcttctaagagttttagcatttatatttaggtgtgtaatcaactttgagttaatatgtgttatgttatgagttagaattttgcatttagataactagttgtcccagcactattcatagaaaagaccattttctccattgaattttcttggcacctttgtcaaaaagcaattgaacataaatgtagtagtatatttatggtttttcagttctgttctactgatctgtatgtcaatccttctctcagtaccatgaaatcttgatatgcagatatttgtataattgttgtgtctttctcattgattattttgtcattataacatgctctgttttgcctgtggtaaaaatttttcacttacagtatactttgtctgatgttaacatagatactccacatcattttttattgctatctgtatggcatatcttctttcatccttttctttcatcttatttgtgtccttgaaactaaattacgtctcttaaacataacagttgattcatatttgtttgtttttatccattctgctaattttgccttttgattagtcagtttacatttattgcagttttggataaggtaagatatgtgcctgccgttttaaaatataagatatgccatgtgaaagacacagttttatttatatctttatcttataataactttataagataatatgttttatataacataacattatattaaaataaaacatttataatagctgacaaaatctttgtctagtaagtccaacatttaagcttcctcagggttagtttatgttgactgcttttatttctgtatatgggcaatattttccgggtttcttatatgtctcataagtttttattgaaaaatggacaatttaaattatataatgtggaaactctgcaaatcaaatgtccccctttcctcatcaggattttttattattgtgttgctatttgtttgtttagtaactttccttgactaatttgtaaagtccataataagcctttgttgagtgtgagcactgaaatccctgctcagttacattagtggtcaggtaatgattagacagagattttcttaagtgccttgaactaataagtcttccagcctttactgaggaccactttgggtgtgttgaggcacatcttcagtgttccagtagtttaaaactctgcccttcatttttgtactttctgcttgtgtagagcttcaaggttagccaaacatgagagatgacgaatttctcaggtctttcctgggcatgtgcacaaccttgtacatatgtacagccatctagataaccaggaatatgtcagtgatttgcaagccccctagaaatctcattctccagatttgccttttaagatttttgtcagcctccagcttctcccaactcatatgagcacctcagacagctacaatgttaaataattgttgctgatttttttttttttttggaaaatgccctggggataaagctgtttgcactaagctttaagtcaagctaaataaagacaaaccttgtgaacagggattttccatggggttctagataggtcaagtagtgacaattctctggtgttgaggcttttagggggctccaaaactgctctgcccatccagtggctgctaggctgctggttttaacagctaccatggttgcaaggttgtcaattttcaaggctcctaaggacctaggaagacagggaggtgagtaggacaagttaaaaagccagaaataccactggtcttttttcctttttttttttgttgtttttttaatacatgctcctcaaatagttccaagcttttggtaaattttgaaagctccgaaaaaagtgtatttcacagtattctcattgcttttacggaagaacagatttcagggatctatactccactgttgcagaagtgcttggtccactatatatatatacatttttaaagatttccacatgcatctactacgaagctgtgtccagaatttattccttccagcgggttcttggtctcgctgacttcaagaatgaagccgcggaccttcacagtgagtgttacagctcataaaggtaatgcggacccaaagagtgagcagcagcaagatttattgtgaagagcaaaagaacaaagcttctgcaatgtggaaggggacccaagcgggttgccgctactggcttgggtggccagcttttattcccttattttattttattccagcttttattcccttatttggcccctcccacatccattggtcccttttacagagcgctgattggtccattttacagagtgctgattggtgcgtttacaatcctttagctagacacagagcactgactggtgcgattttacagagtgctggttggtgcatttacaatcctttagctagacacagagccctgattggtgcatttacaatcctttagctagacacaaaagttctccaagtccacatccaacccagaagatcagctggcttcacctctcaaagcccagactgagaatgacagtataagtctcttaaccctctagtccttcataggccttctaaaatcccaaatagtcatgtaagttttaatctgagaatcaaacactcacaattctttagtgctttagaaaagtgacatgtatattttcatattaataagctgttaaataccttttctaccttccttgcctactaaatctaacctttttcctttattcctatatgcaattatatttatttttaatttgttattgtatttatcaatgaggatgaaaacattaatatgggtgggctatgtcattcttatcctaaatgcatgtgtgttttcttctaccccatattactgcttactatctctcacacactcacatgcacacaaccagttgcatctatgaaaaatgtcttagtctccgcttagaattttatcttcattaatttaatattgtgaaccgatccacttgtcccagaatgtctgtgcttcgcttctctaccaaacaagaataatagtactcggaaagtgggctggttttttttatttgttataaaatgaagaggcactttgtgtaacgtaatcttttttaagatgttggcattttctcattgctaggattatgcttttaaataagtatgccttgaactgagaaatgttgcattaaaattatattactgaggccagatgcagtggcttatgcctgtaatttcagcactttgggaggtggaggtgggaggattgcttgagcccggtagttcaagaccgactggggcaacacagtgaggactcatcctacaaaaaataaaaaaattagtcagatgtggtggcacacctatgtggtcccagctactctggaggctgagacaggaggatctcttgagcccaagaagtcgaggctgcagtgagcagtgatcatgccactgtactccagcctgggtgacagagtgagaccctatctcaaaacaacagtagcaacaaagaattacgttactgagaaaagcaccctgattttgtctcccattttagatgaggaacataccactgaacacacgccgaaccaccatgtgcctcagcccccacaagcagtgttcccagcatgcatctgtgcagcagtacttcccattgttcatctgatggaggatggtgaggtgcgggaagatggagtagcaggtacagttttgaacagtcagatcatcagtgacattcttaagctgtttatctgatagaagacagtaggttgctcttaaacacattatctactggccacatgttgaactgttttatgcacatattataattacagatttgtaacatactgcgctaacagtatcactctctccacctccttctccctctacctttatggccaaaaaaattgcatttaaaataggtaattgggtccaggagcattgttcgtgaccagagaacagaacaacacaataattatttagccacatagaaatcaaaccttagaaatcttagctattagcttgacaccactaataccatctctcttacgtgattacctttcctgacgtgctaactacctaaaaagaataattgcaaaatgaaacgataaactaagggaaaagatgagtaacatttgtgacagacaaaggttaatttcttaacgttacattttaaaaagctcttataactcactaataattttttaaaaccccattagaaaactgggcaaaggatatcagcaggcaatccaatggccagtaacacctggagacaacatcgttgtttaaaactgtaataaatcttacatttcagccagaaagtcggcaaatattactttaaatgaaaatatctattgctggtgaaaaagcaggggaaagagcatcctcatactttgctgatgaagtataaaactctgtacaagcattctagaacagagtttcatgatatgtatcaaaaaccttaaaagtgtgaaaagcttttgacacagatttggcttctagcaatttcctaagacaatcatgagggctgtataaaggacattgtacactgatcattatttaaaataaaaaatatttagaaagactttaaatccctaacaataagcaattagttaatcatagtacctccatatgataacattctgtgaatgctggaattgcattctagatgaatattaatataaaaagtgttaatacattgctaagtaaaaaaccgaataccagagaatattttctatatatagtactattttaaaatacatgtaagtagactgggcacggtggctcatgcttgtaatcccagcactttggaaggctgaggcaggcagatcacttgagatcaggagttcgagaccagcctggccaacgtggcgaaaccctgtctctactaaaaatacaaaaattagccaggcgtggtggcacgtgcctgtaatcccagctactcatgaggctgaggcaggagaattgcttgaacctggaaggcagaggttgcagtgagccgaaaccgcaccactgcacttcagcctgggcaacagagtgagactccatctcaaaaataaaaataaaataaaataatgcacgtaaatatatatttcatgtatgtgaaatgacatactccaaactgttaatagttgtttctgtgatgagtggacttcccagtcttatttttctctttgcatttttttgtatttttcatgttttaagcatgaaactgccttacttaagcaattaaaataaaaataacatgaacatttttaaagttttaattgacacataataattgtacatatttatggggtacagtgatatttcagtacctgtatacaatgtgtaatgatcaaatcatggtaattagcatatccttcacctcaaacagtatttctttgtgttaggaacactcaaaattctctcttctagctatttgagaatatagaataaattattgttacctatagtcaccctacagtgctaaagaacactgaaacttattcctgctatctagctgtaatttcttatccattaaccaacctttcccatgcctccctcccgcctccccttcctagcctctagttagcactattctactgtccacttccgagagatcaacttatttagcttctacaaatgagtgaaaacatgcaatatttgttttcctgtgcctggcttatttcacatgtaaagatatttttgcaatcaatatcaacctgagaaaaactcacacctattttaattagttatagagacacatgaaagctacagctctggatttatatttttgttaatattatttatatgtcctttaactttaactgtatggcttgtttctgaatcaaaatttggtatcatttatttgaaataaatttatgctaaattctgtattcctacttttgaaaaccaatggaattgggaaacacgttgaaactaaagaccattcagtgcttactggccctgttttttacccacttgctttcttagtctgggtacttctagacaatcttagcctgaccgctttccccacagaaatagcactttctttctcattaggattaattatttattcttaagacttcttcgttagaagtgagaacctaattgttactggctcaactactttatcttgctgaaggagatactgtttgaagcactcatgtggacagaaaaaaaaatccctaattcatatgcattctaaaccaaaacatattttcaaaatccaaatagtctttcatagtttctccataaaataaacaataaaatatgactgtaatttaataagtgctgactgctgctattattggggtgacttccacaacaaagacaattgcatatattcacagagatattctttgcaaaagcattgctgatacctgaagacaactcctacactttttggtaacctgttctttacatgtgaaaatgttcagagacaacaacgaagagaacaaacacctacgttgcaaaagaaaaaagagttcacagagccttttaaggcaaaaagcagagactaaagcttgtaaattgtcaaatactttatctcatagacttaactccattaaagacaaatgttcaactttctttctcttctgaagtgagtgctgtggctcaacaagtcttatggaactgtctaattgaagatccatcaacggttcttcgacattttctggaaaaactgaccatcagcaatagacaagtaaattcctcttcctttttagtgtagctctgtggctacaagtgtgaacactgttaaaatcatgcaaagaactttatagtgcagtgcatgcaactcaatgccctccaatacacaaccaataagtactttttaaataatgataatgatgagcaatacttaactttgctgtttttaatttctccattaattcatgtttctatatatatatatattacattgctagtgaggatcctaaaatactgcaagattaaattaagtataatgttcttactattgagtaccttcattgaattctgaatgcttggcagtctgatgcaggtatgattattagaatatgttaaaatttttcattaaccaaaaacctgatttgtcagaccaccttgtaagaagatcatgccaaataaaagtagtctttcaagcagtggcaaaatacagcgatgattaaaaattatttgttcatttctatgctatagtcatattcactggaaggttaagtttagtttctgaaaggtaaagttaattatagacatttcaatctagtctcttgtaacctctctttttctctttgactcaaaacctagaaagcagaattaagacattcacaaaaacatggtttgtttaatgatttttcaacataggtcctcctcatagtcccgtcatatcaggctaccatggccaatagagttaactaaatatacagctttcctgtgacttgcctgtgacctacacacacagtgtcaatttaaaaagaacaaagtcgtttactgctcagtgatttttatgtgttagctcctaggagaaaggtgttccagatggtttaaatactacttaacaagtatcacatatactatattaaaatgttgaacataattgaaatcaatatgtgggcaaaagtaaaaaaaatccctcacccaatcccgaattttcaagaagttaattttattttctacagcatggcagctgaaggaaacattaaaaattctgttcttctttcaggatgagttaatgtacatgctgcgcaaacttctcttgaatattggagactttcctgctcagacatctcacatcctattcaactatttggtgagttataaatgttcatttccaattacgaagcagcaccatgatgaaaaggtcttagaagatttttttcaataaatttccattaattacattactaaaggcaaatcctggtcaactaaattctgtgtagggaagcccctgcctggcatactctttgacatatggaggacagtcaatataaatgtcagttcctctctgtcttcctttagcaatatataactttcttatgtttgttgtttatttttgttttctgttgagaaaacatgtgttcttttagtattttttcctcttttcctatctctatgtttaaacacacacacacacacacacacacacacacacacacacacacacacacacacagatgcaactgttgtcctagatggaaagtttttgtgtatatatttttgcatggcaactgtctatgacagttttaactgccctggcagttcttttctgatcctctgagacttaccaatttcttcacattctttttttaaaccccagatgaatatgcagtttggggactagaacctgatgactacaccttgaaactgccccttaatccaggcagacaaatagccaaattaatgtctgtgctgagcatactccttcagttatccatatgcatatgcatccctagcagggtgataaatttaactcccaccacaacccccatgtgcagagaacatttgtaattcctttctcttgtctaagactaatttggtcatctttcttccgagtgcctacttgctggttggcaaaggaaaaaaatatgaataaatgtccaatccagatttaagttcagaccggtaccaaaacataaacagtacattttggtggttttcagtctctcttggataaaaatgcatagtctctaggaattctccctccttcacactgcttttgtctctatagctatgtggagttgggaagaaaaaagacctgtgttccacatctcaccccttgcattttatctgggtccttcatttgtgagaccatgttcttaagtctggctggttgctggatatctggatgggcacaaactcaagcccatggctgctgtcactcaaagcctgtctgctcctggcactgtttgccaggagactcaacctccccttagcttctgtgggtgctttagaccccctgagttcttgccatgagtcccatagggctctaacataggaagtccaccagctacagcatcctgctcagtgacaacagcctatggccgttctatctggaaagctttccagccaagcatccactacttctgggttctgtctacaccacacgaaaaccaaaggtggatttggaaagccaaatgtcagggcctccctcagtttaggtgtgtgccctgccaaatttacactccatccaggctggtgtggaaagagcccaaagagggactggagatgagagcgccttcagtgtttctttcgcttgcctgtgtacctgccccttccccaggtcactgaataggagaaatgcttgcccagaccattgctctcctccatcctttagctccgcaacaaaaatatttttaagggagcttgatgcccagatagttttaaaagaaataaatctccaaatactcaacttaacagatatgcactaacacttgttgagtaagtctgccatctcaaccattattctagtgcacacaaggaagacccaacccatcatcccagagattaccaggctgcactgacaggcatgtaggttggagaaagaatctgaattctatgttattagtagttttaagaaatcatcttttctgattgatcaatgcactttaacccataggactttctatctggtcctatgttttataaatttctattaagggtgagggttggccctccttagggtgtccagcatttagaacaccaaaacagattaggtttgcgacactgattctttcaacataactacaaagttttccaggactacaaaatttttgaagaaacaatggttaaaacccacaagaaaaaaaaatttacactatttctttctgaatatttgcacattattgaataggataattgaaagttatttcatcaaatattccaattatagtcagtcctcatcttatttcaatgtatagaatgctgaacatattctacctcctattaacaaaaaataaacttgaatgaggcattttagatgtcaactttaaaaggtgcaaaagagcacacagtttttcaaaattacattagaagatatgcaaacaacccagctgataaaataatgtaaggtttgtcacaacaaacctcatgacacacatttacctatgtaacaaacctacacgtgtacccctgaatttagaaacaaaaaaaaagaagacacacaaaaattttgaagttcatcaacttagccaagcagtgtgctcttaggtttgagactattagacataatccaagctgcaaatagtgcttggacaaacttcttatacagatgaattttagatggcccaagtacctagctaccaagtgacatgatgcctgggtggggggaggggggaatgatctgcttttttcttaagaattcgccattttaatgatatataaaaatgtacagcagcctgtgtggtcagttttccagttatgccctctcctggtaacattgaaagtgttagagaagcatctgaacagagaatatgaaggcacagaagaaggtcgagtttaaaacaagaaaagctaaggaaatgagaatgtgagctcgggattattgtagctttgtgaactcttcttatactgacttctaggtaggattaatcatgtactttgtgcggaccccctgcgagtgggggatggatgccatttcagccaccctgacattcctgtgggaggtggtgggttacgtggagggcctcttcttcaaggatctcaagcagacgatgaagaaggagcagtgtgaggtgaagctcctggtgaccgcttcaatgccaggtaagccactactactttttagtaacataactttaaaaaaaaattataaatagccctttgaaagactaagagtctctttcattcatgagaaaattttcagagttctaacccccagtattgagtgcttcaaagaatttttgtttaatataatcagaggaaatacaatagaccctttaaaaagtcagcggttgccagctgaaaagggagactcagaactgagatccgcatgaatcagtccttgaagggctgccaaggttgaagatttatttaagtctattgcagagagccagctgaactgaaagcttgtttgagtgaatttttggcagtgcaagaataatattgtttgtatggcatggactccagtcttttgtaaactccatgagtgagggctttatgaaaaattggaaaaggggaaagcaggaagaaggagcattacaaaagaacatgaagcgtgatgtaaactcaagatacggttccttttcacttcggatagcttgttttgccttaagacaaagatttggacaattctttatccttgtgcagtgactaagaaaatttgagatgatacatgtattgaaatagaagtgaaagacagaattatgtagagatgagaacacaggttctcgcagcaaaaaagcctgtgtttaaatcatagcactgtcatttattagtcacataactagtattaactgtgaagaagtacattatttctcaaagctttctttctttgtgtataaaatagggatataattcatacttcacaattgtgaggaataaatgagttgagatatgtgaaatacttgctgccatacctggctcatgataagcattcgatgaatgggaattgtgtatgtataggttctgtagattatccaaaaaaagtgatcagtttttattacagcaaagaaactcctatttttaacatacttaaaaacaactcactaaaaattgaggtatatcataatgttcacaaagatttgtaattaatgaatgaagtagaataaatattgtctccatcagccaagaagaatacagaaaatgtagctttcagctacatttcaagtacatgttttggttttgctaatatccctgtttatattttcttaacttttattgcctggtcacctcatctagaaaacagggatgtactacttgttgaaatgcttgaggtttgaattctaactcttccactaaataaatatgtctcttaagttattccatttctctttttcctcatttgtaagataaaaaatcataacacccacatcatggggtggctatgagatttaaatacaattatgcatgtaaaagacaggtagaagtattgagaacttggcctagcgcggtggctcactcctgtaatctccgcactttgggaggccgaggcaggtggattgcttgaggtcaggagtttgagaccagcttggacaacatggcgaaacctcgtctctactaaaaataaaaattttttaaaagtattgggaactccatacctatcacttttaataagtgaatatatttaaaatatatgtatattaatcttaaatttccaggttaaaaataaataaaatatatatgtaactatgaattaagaattgtaattaacagtaaaaacatcagcttattgataatattttaatattttatgctttaaaatacaaattttctatagtaaaagtcagtttgttattatttttatcatctgtaggtactaaaaccttggtagttcatggacagaatgagtgcgatatcccaacccagttaccagtccatgaagacactcaatttgaagccctgttgaaggtaggaatgacttttaacagaaacaatttttaaggacaatgctatggccacctcactgaagatccattttagaataaaatggcatttttctgtctttaaatggatgtatgcatttctttactcttctaaaatctgccccactattatttccttatgctatttccttccataattttccccacttctactgactttagtcagtaaacttttagtaatctgattttcaggaacatagttctgggcccagatgtaagtagaagagacctttggaaaaaaaatcaacttttccaaactcgtgcatcttatttcagtagaaagggacattactactccttttgtcctcattcagacatctccagagaatttctaaggcccaacttcaacaaatactccatttttatactcacgatgaatggtaggatagcaggaaggcaaacagagtatattcaaacgctgccttcaccacaaccagtgtgacctaaatcaagtgataagacttctctagtctcagtttcattttcaacagtactgagatactagttcaggttatacaagttatctatgcctagtatatagtatataatgtgcacagtgcatgatagtttatattattcttaagtgtttctcaaacatgctttcttcctgatgctgagaccagtaggtgccactgttcctccacagtccatcactcagtctgaattataattgtacatctttgggcactatgagatcagatggtccatatcacattatcagtctttatcgtaccattctttggatagctctgtgtgggtatatatgcagccatggtatgtgtgtatatatatgtgtatatatatatgtgtgtgtgtatgtgtatacacatatacacacacacatatctaacgtatacagtttacataagacatcaatatatacagataattctcgtaagaggttaccttgttttttcaaaatttgtatctgtcaccttactacctagcacataatatcttcctgataaacatttattaaaatttgttgctattgttctaggagtgtctggagttttttaatatcccagaatcccagtcaacacattattttcttatggataaacgatggaaccttatccactacaataaggtgagacaccagtagtgacatccccgttgagttgtgccaaaggcttatcatgcctacctgagggtggctcacagtcagggaggcatcgctgtttagaaggtaatagtatggccacctgggtcacaccatcttactatcaatggggcttttgactggcgacttcacctttctaccctttggttttcttgtgtgtaaaatgaaggtaatgataatggtatccatgctagagcagttgtaatagttaaatgagataagctagataagacacttaggtattgatcattattacatgaaaaattacgttgcccgtataatacctgtgtgtgtctatttggaatttgaatgctgttttgcatctcttttctaccatgttaaacaagaccatgctgatctgatctaatgagcagaagggcctcaggatgctcgctgacatcactttacagtgatcttccagagtgttgtttagtacattgcctttagctgcttttctcctggcatagcatcctagtgcttagatctttgggtaaagaagaaatgagaaaagatgtttaatcttttgaactcttttttttgtctctttatgtaatccacacagacctatgttcgagatatttatcctttccggaggtcagtatctccccagctgaatcttgtacatatgcatccagagaagggacaggagctcattcagaaacaggtgacagaccacgtcagttttattccatggttttgtcatgttgttggagtagatatctgttcatactttgccaactttgagattttatgattccattttgaccctctctggagacagtagttggccctcactcaacaaattattcccctaaatagtgtaagatttacaaattggatcattgcttaaaggtagtaagaaacactcacttggagtagtgtaatgatgaattattgagtataaataatagaaatctcctaattatttacctattattttctatatgtagattttcatttcacatttctgtaaaattggattggaaatacacataatgtagctatgtaaattatcccagtggtttacactagctggctacacagtaaaaggggtcactctagtatgcttgaaaaaaaaagcattaaactaaagttcaaagatttggacttcatcccagttctgcctctgaccagggatctgaccttgggcatgttattaatttctcttgaaacaggaagagatatagtctagcagctgtacttaggtttaaggttgaagaacagaataatattcacatttaatctcaaatcaaactttgagcttaaggaaagtcactattctgcatgcaaaatatagctttagtacacaattctaaaaatgatacaattttaatattgcatatttattacattcatttttaaataaaatctttaaagaatttcaggatacttgatcatttcaattttctgtacatatcaaggataataatttgccttcaaaatatccaaaaatatcttcatgaaatgggtgagcatcgcatagaattagaccacttaagtaattaaaaatatagctacaattaactaccgacattctatttaaaagaaagaaaatactaaatgtgttgcaaggtgtgagatgttgggcaaaactattagatcttaaatataaacaattcctaaaacaattctcctcaaattaccccagcccatgattttggggtaagataattgaaaccctaatcaataatggtgcttgcctagtctctgtctctctctctctctctctctctctctctctctctgtgtgtgtgtgtgtgtgtgtgtgtgtctattcatcatgtttaagaacaagttttcaaagaatgccatcaaatggagttcttgctctgatgtacacttcaagttagagccttaagacttctaagttcctcagggagattataacatggaggcctatgagtctggctcagaagtttcctcagtagctactcactgcatataaacttcctaatcatcaagagaaaaggacctaagaaccaagagccccatgtgtatgccctctaaactcagagcaccaatcaaggacctatgagcttctgtcccaagatagggttttcctggatctcacatcagtctttgtttttttaaagacaaacccggaactcccaggaaacagcttcaggcattggtggcaatggaactgactgactcactgaccctgttagtgaaggtcttccatattatagcatccaaacaaatgggctctatttaatattgaactaatcttgacaatgcttgccttatgctcctctccagcctaaaactccataaggaacatttccttctgtaaagcaggcagaaggaagtaagaggcaattgagaattgtttgctcttgcttgtggtaaaggataaaaacacatgtctccctcatttcactttttccccttttccgactttatcaacccagtttgccattaaaggttttcctttagttttttcagtctataaatctggagtttctaatactcctttttgtctgctcctgcttttgttttctccaggtgttcacccgaaagctggaagaagtagggcgggtgttgtttctcatctccctaacccagaagatccccacagcccacaaacagtcccacgtctccatgcttcaggaagacctcctccgcctgccctcattccctcgtagtgctattgatgctgagttttcactcttcagtgatcctcaaggtatcaaacaaagaaacattgcctctctggggctttttctaacacacttgttgtttttttttaaaattttattattattatactttaagttttagggtacatgtgctcaacgtgcaggtttgttacatatgtatacatgtgccatgttggtgtgctgcacccattaactcgtcatttagcattaggtatatctcctaaacgcacttgttttgttctcaaatggagagcatctgaatcagcagacagtgctgtaaaaccagtgcttctcagacctgagtgtgcacaagagacccctgaaggacttgttgaaacacagattgcggggccccacgctccacctccgggtttcaggatggggctcaagagtttgcatttctattaagttctcaggtgatgctgatgctgctatcccaagcaccacattttgagaaccactgctctaagctagtcatcagcagttgaagcgtgggtaggatggtgttgttagggtatgagaatacttgactaaacaaagaccgggtatttgtgtgaagttcaaaaagaggcaaaattcatctagaatgacagaaatcagaatggtggttgcctctggatttggagggaatgaatttcctggaaaggggcagaagggtgatgaaaatggtctgtatattgatggaatgttgtctacatgagtgcatagtgcatatttttgtcaaaattcaatgaactctaaagatctgtgcattttactctaaataatacctcaattgagagaaagagagacacagaaggagacccactttggagcctcgctctgttactcagttattaatttgagacaatttacttaaattagcatctctatgttttatcgccctcatccagaagcttcagacaggctgggcaaggtgactcatgcctgtaatcccaggcctttgggaggcccagggaggcagatcacttgaggtcaggagtttgagactaccctggccaacatggcgaaaccctgtctctactaaaaatacaaaaaaaattagctgggcatggtggcgggtgcctgtaatcccagctactcaggggtctgaagcatgagaatcacatgaacccaggagatggaggttgcagtgagccgagattgcgccattgcactccagacagaacgacagagcgagactccatctcaaaaaaacaaaaaacaaaaaacaaaacgcttcagcttcagcagtagatagagctctagcctctgaccattaattaaaagaccaagcagtagtcccatccctgctattttctagctgaaataatttatttttctccaacagatgtttatttagcagtaaaacactgccaatgcctgctctgccttacccacagttagttaaagaggtgatgatgaaagttcatggagaaaaggaagtgctgtatcaaggccagtaatattgtgctggaaaacatttcagcagtagatcttcacatcctggagctggaacaaacggagaacagcagcgccttgggtttgatcacctctcatgctgacaggattggtgtggggctaattctgtctctgctgtttcatgttctcacagctggaaaggaactgtttggcctcgacactcttcagaaaagcttgtggatccagctgctggaggaaatgttcctgggcatgccgagcgagtttccatggggagacgaaatcatgcttttcctcaacgtttttaacggggctctgatcctccacccggaagacagtgccctgctcaggcagtatgctgccaccgtcatcaacaccgcggtgcacttcaaccacctcttctctctcagcggctaccagtggattctccccaccatgctgcaggtgcccagaacctcctctcccaaccagaaaattaacatgagtactgctcatatctagccgttcaactagatctatactgaaactttttaatgatggtgttatcatcttcttttgtgacaacagaaggcaacaaatgaaatccccccataaatttgcaagagttcacaatgttcctttctactctgagagccccagacttgggatatgctttcccatttcgtctaggacagtggttcttaagttgtagtccctgggccagcagcatcagcatcaactggaaacttgttggaaatgtacattctggtcaggtgtggtggctcacgcctgtaatgccagcactttgggaggccaaggtgggagaatctcttgaagtgaggagcttaagactagcttggggaacacagcaagaccacatctctaaaacaaaaaaaagttttaaagaaagagaaatgcacattcttggagcccatccaggtctactgaatcagaaactcagggatcagggcccagtagtttgtgtttttaacaagaccttcaaatggttttgatgccctagaacaggaatcctctacctccgggccagggaccagtactggtctgtggcctgtaaggaacccccacccctagattttcataggagctggaaccctattgtgaactgtgcatgcaagggatctaggttccatgctcctgaatctaatgcctgatgatctgaggtggaacagtttcattccgaaaccatcccccgcactcaccctggtccatgaaaaaattgtcttccatgaaaccagtccctgatgccaaaaaggttggggaccactgccctagaaagtttgagaacttctgttcttgagtcacatgtatggcaagtgtttagctgatgtttctcccgagagattccctgacctctaactgaatagagattttcattcccagtaaatgtggtgtgttgggattggagaaggtaatttagcaggaacaatttttatttactcgtgtctaatgtatagctggctacatttaggagtactaaataaaatcaggcagggcccaggggctcatcctagttctctatttttgaggaagttttgataaaaattatgatcacaacacatacaaagttaagtttgctcaacctatgggggcaagaaagttactatcacaggactctcttcctcatttttagatagttgcaattttctctatttttttagtaagtattttttttttactgattaccaaaagcgattatgttcattacaaaattcaaaagatggagaaagtttaaagaaaagataaggctcacttaaaatcctttctcccaggtaatcattgtttatacttacaaatcctggcactctttcctacacacacacacacacacacacacacactccagaattatatattttcaagtttgtaacctagttttttcatataacactaagaatatcataggcattttatatagctatatttagccttacagcatttttaaaattactgcacagcattctatgatttgtatataccataattcacttaaccaagatatatttatgaataatttgtctcatattttccactgttatagccagtcttgcagcaggccttcttatgtatgcatgtttatacatgtgtctagtcctttccttgagataaattcctagtcacaaacttcctggaaagaaagtatgtttagattttcagcattttgaggtgtgttactaaatttatctagagaaagtttatgccattttacattcctctctaccagtttacaaagttagccatttccctccaagcttcccatgaccatgagttttaaaagcgagtacaactttgatacttcattaaggcattttttgaatatctggcatttttccataggtgtactccgactatgaaagcaatccccagctgcgtcaagccatcgaatttgcctgtcaccagttctatattctacaccggaagccctttgtgctccagctgtttgctagtgtggcccctctcctggaatttcctgtaagtaagctctgtgggaaaaaaaaatgaagaccaacaaaatgagaaaagcaaaggttatttattagagcttactatggcaagggagttggctaccatcacttgtgttttggcagagatgcaaaggcaggcagaggagtcgaaaaactgtatagtgaaaaaaggagaagcttcaggtatgtcctgattggagctattggcctggggaagctgcaggtgaactaactagtagttgggcatcttatatgatgggttaggggtgtatattgggctttctctggttggtcctaagttggaagcagggacaaaaattaggaaagctctcagttattatgccagtcctggttactttgggccagttgttacagaggttattgtttggttaccactggaggtagtggcctgacttcctacaagcctgacttaggctggcttcctgagctggttattgtagacaatgggttggtttcctgagcaggttgttgcaggttgtgggtcaaagttctatctttatatatgatttagtcattgacagtttgtatattcagtctctgagctctctttctttaaccaatgagacatgcataccataaataatatttctttcaacaagcatatcatttctcttcaacattcctcttcagctttcatctcagctcctaacacataaatagaccaactctacagttttttaaatattcaattcataaaagagatggaaagtagaaaacggtaaaaggaaggtttcccaattttcattcctttttgtcactctctaccacctaccctgctttgtttttctttttcttcagagattttaccaccatatcacatgttatatctatttgtttcattaacatgaatttctacgacactcaaccagcagaatttaatcttcatgaaagcaagacctttgtatgcttttgtctttgcttgtttgtttggttttagttattgttgtatcgttgttttatttgcattttgtttttggttttctataacctcagtgtgtagcctggtgcttggcacagaagaacatcataaggatttgttgtttcagtgaattatttaaagccattttaaatagatttaaaattgtaagtatctccatgtggagatacattatcaaagaagacctgtgaaattcccagcgttgttagttaaaataagcatacattccgcaaacatatttgtagtattcaaccaatcaattatagaaattttcttagttctgccatcttcaattaaaggaaccattgatatgaactttttggaagttcatatatcgctgtatttttgtgagcttttacaaatatctcttttgttctatattagaatttaatagatcccttaaaagtcaggtgtaccactccaaaatcataccacagcattgcgggatccagaattatgtaagctgaattccaggtagatgttgtacttgttactggtaatagcatttataaaatttgaattcctgtcaagttatagttttactgtggtgggagtcaataaacaaaaattgtttttctttatcaggatgctgccaataatgggcccagcaaaggtgtgtcagctcagtgcctgtttgacttgctgcagtccctagagggagagaccaccgacatattagacatcttagagctggtcaaagctgagaagcctctcaagtcattaggtaaaagcaaaacttgctttgacattctttttctcactgcagttgttaaatataaatatatgtattatacacacatacacgtatatttatatgtgtgtgtatatataactaaatcaaagtagcaaaaataaatggaacagtagtagaaattgaatgagtacattttttttcttaaatttcttatgaatcctaaagagtaaggaattctctgccatgaaaactatattaaaatgatgctcagtagaccactgctgtagcactgcagttttcagaaagttgggttatcttgggtaattctaagtgaataactctccaaaatggtcttttattatcatggaatgtgtagaactagagataactccagggtaaagcctcaaccttaggcaatttaaatgcccttcagtgtcttctattatctgagatttttttaaacactccagaaaagtatttttattttacatctgattgttcaaaactagaaaacagaatttcgttcccttgagatgaagaaattaatagttttcacagcgtaggaataaaatttaacaagaaaaggctacagtatatactggaatgataacattaggagtaataggtgcttctttatctcctgcaaaatccactctgatagtttgcctttactttttgttccttcagatttctgctatggaaacgaagatctgacattttctatcagtgaagccattaagctctgtgtcactgtggtggcgtatgctcccgaatcattcagaaggtatctgcagccctttattctgtgccttgtgataagtaaatatggcagagaaaataaaattgaatgaatacaaaggttatgctgattaatatcagactaacattctgacaagtaagcttttagaaactaaatttaggccaggtgtggtggctcacacctataatcccagcactttggaaggctgaggcaagaggattcctttagcccaggagtttgagaccaacctgggcaacatagtgagaccctgtctctacaaaaattttaaaaaattaaaaattagccaggtgtggtgttgcacacctgtagtcccaactttttgggaggcttgaggcaggaggattgcttaatcccaggcggtcaaggctgcagtgagctgtgattgtcccattgcactctggcctaggcaacagagtaagactttgtcagaaaaaaaaaaaaagaaagaaagaaaaaagaaaaggaaagaagaaacaaagtttaggaaacatagcataggttctggaaaacaatagtaaatcttcattcatttgaaatcccttaatttgaattttgtgcagatgctaaggtatttagtcttgttagaaaatatttttcctcacaagtaatgtgaattagtagcaaacaaaatttcataacagatatttatttaagaaaactcctttcaaggggcaataagaatttctgtaacacaaagggcaagaatatcaatcttgccttcattttgccaagtacagagaattcaaagactcacatgaagaatgagtcatcccaattcaaagatgttggctctggtctgagatttaaatctgatctattaaaagttgtactctgttgacaagctcttccaggaagaaggaaggagccaagctgattatgcccaatatatctttatatatttgccctgcaccttaagcctgtttctctctcccataagagaatgaataagggccaggaggagcgggatttatattaattgaactctttttactggagggacacatgaggaatgagtaagaagtgttttccccaatattctcgaatttttgtcttctggagcaatggggagaaaaacagtatgcctgtggtcaggcacggatgtggctgtggccttcaggagaacaaagctgcaggatggtctcatttctgatctcagggtatggaggggatttcctactcccattttcttgctgttcctataataccactgatctacaaaaagttccagaatggatcaaatcctgcattaagttaactccaaatccattctatacgtgattgtaaacatcttctctctactctatttgccattccaagtgtgttcagctacgttgttaaccagatatgtcagatattctgcaattgagacactgcaataataaaatgcatacagattctccaatattcctgcaacatagagaacacctaagtttgactaaaaagttctcccatttcaaattttaccaaatttccattgagtcataaaattctctttcaagtcaaaattcaaacacattgaaatcaaaaggtgttagagttcacaatcaaattcccttgtcattgtgagttaaaagccaaagtctaatattgttaagttaaattagaattttttttaatcctcctaattttccattctgtcagtttaaaccagatgacatcttgatgtctcagtaaggtcagggtttcttaagtagtggttccctgggatatctctcatgggaataagtaacatacctataggacttcaacatttgtaacagcaagtctctgttgtacttaattttttttaaaagtattttatttaagtgtaacattcacataaaacactaaaaaaatcataattttacagttccatgaatgttcataatgttatcacatctacataactaccactcagattgaaaaatcagatagaggcactactatcctgatttctaatatgataaatcagttttgcctatttctgaaatctgtttaactgaaatagtatagtagctactttttaatgtctgacttctgtcattcagtattatttcatgagattcattcatataaatgtgtgtaacagtagttgattctttttcattcacttataatagtcataataattgtatgactatgttacaatttatttatttcttctcttgttatcaggcatttgtgttgtatctagtttgaaggtattataaataaagctgcaatgaatgtttttgtatatgtctttgtacacaaatatttatgcatttctatggatggaactgctgggctaagtcatggactatgagtatttcttgctttagtagatactaccaaaaagttttccaaggtggtttcaattttcattcccaccaacagtatgtaaatgttctagtaccctatggcctcatcaacacttgttatcttcggtctttttattttagctattttgttgggttgtagtgacatccattatcattttaatttccattttcctctttcaaattaaaaggtttggaagcttttcagataaatgtttatcaaaatttggacatctccttttgcaaagtgcctactgaagtcttctgcccatttttaaatgaagttatcagtattttttattttatatgtgtgatttcttagtgttttctatttaattaattatgtcatctgcaaatcatgagagttgtattttatcctttcaaattcttgtacacattattcctttctctgtccttaatgcactggctagaaccttaatacaaaatggaatagaagtgatgatggtgatgatggtgggatctttgtttcatttctgatcccggggtatggaggggatttccaatatttcatcactaagaatagtatttgctaaaggattttgttgtaatatacctgtaaagattaaggaagtaattttattactcattaagaaattaattattaaggagtctgccttctattcttagtttagtttgagttttcttattgatggataatgaatattaccaaatgttcctctctatttatagagatgattatatgatttttattctttattttctaagtgtgataggttacactgatttattttcaaaattaaaactttcctgtctccttaaaaataaactgtaactgggttgtataattatcatttttcagtattgctagatttggtttgcaattattttagcatttttacaactatgttaatgagagctatgtctgtaatttttattctttaaaaaggtcttatctaatgaattttattgctaggatcacagggaagttaggagtagaagagatattctaggtagctctatgtcattcaagataaaccaattctggatacttaaaaaagttacaagtgcttaaacaaaaaggatgtcttgcttagctactactttattaactacccactggtaaacgttttagcaggtgtatttgtaaccctccattattataaagtccttgtcaggctatagtatcaaggatatgaagattaagctggactcataagatgaaatggaaagtgtctctcctacccaccccccgctttttaattttcttttatttttgagacagagtcttgctcttgttgcccaggctggagtgcaatggcataatcttggctcactgcaacctctgcctcctgggttcaagcaattctcctgcctctgcctcccgagtagctgggattacaggcacccgccaccacacccagctaatttttgtatttttagtagacatggggtttcaccatgttgaccaggctggtcttaaactcctgacctcaggcgatccacccgccttggccttccaaagtgctgggattacaggcatgagccactgcgcccagccccccacccctttttaaaaactcctattctctgtagaaatttggtatggattagcttttttttatttttgaaacagggtcttgttctgttgccaaggttggagtgcagtgtcacaatcatggcccactgcagccttgatctcccagactcgagcaatcctcccacctcagccttccaagtagccggcactacaggcgggtgccttcacaccctgctaagttttttgattttttgagagataaagaaagtctcactgtgttgcccaggctggtctcaaactcctgagctcaagtgttcctcccacctcagcctcccaaagtgctgggattacaggcagaggaactgtgcctgcctcagatgagcattttgtcttcccaaaatattgagtagaatttatacacaaaactgtaagtaatgtggtttcttgtgggaacattttaaaattaagattctttatcctggtggtggctttggtaagtcacatttttctaggaatttttctatttaatttaagtacctaaatttattgacagaaatttgttcctgatatgctttttttaaaaaaaaaattttaatgactatgaggtttttattgagttcacttttttatttctaatactgggaatttttgctccctccctttttttattattcttttcaggagtttatcaatagttttccctttacgaataaccagtatttggggctttgttgatttttgctattgtagttttattgtctgccttttctttccttttttatctttattattttctacctttggctttttttttttttttaacggagttttcgttcttgttgcccaggctggagtgcaatggcacaatctcggctcacagcgacctccacctcccggattcaagcgattctcctgcctcagcctcccgagtagctgggattacaggcatgtgccaccacacctggctaattttgtacttttagtagagacagagtttctccatgttggtcaggttggtcttgaactcctgacctcaggtgatccacccgtctcagcctcccaaagtgctgggattataagcatgagccaccgcacccagctggatttttttttttaatttaaagaaaatattcaggccaggtgcagtggctcacgcctggaatcccagcactttgggaggccaaagcatgtggattgcatgatttcaggagtttgagaccaacctgggcaacatggcaaaaccccgtccctacaaaaaatacaaaaattagcggggcatggtggtgcatgcctgtgatcccagctactcaagaggctaaggtgggaggattgcttgagcccaagttgaggctgcagtgagctgagattgcaccaccacactccaacctggtcaacagagcaagacctgtctcaaataaattaattaactaataaaataaaataaaaaagaaaatattccattttctactgacttatcatatctgttgaaaaatcagcattagatcttattgcacatttgaatttaacgtgtcctttttttttctctctctctctcttttgagatggaatctcactctgtcgcccaggctggagtgcagtggcaccatctcagctcactgcaacctccgcctcccgggttcaagcagttctcctccctcagcctcccaaatagctgggactacaggcatgcaccaccacacccagctaattttttatatttttagtagagatgagatttcaccgtattggccaggctggtctcaaactcctgacctcgtgatctgcccgcctcagcctcccaaagtgctgggattacaggtgtgagccgccgtgccctgccctaatgtgtctttttctctggctacttttaagattttctctttgctttgggttttaagcagtttgactgtggtgtgcctagttgtgatttttctttgtgtttatacttcttgggattcatagtgtttcctgaatataaagcttgatagctttcaataattttagaaaatttgactaataactcttcacatattacctctatcccattttccctcccctctccatttatgtatatgtattttttcctccttaaccacatgctctatatatgtctcttatgttctttcctgcatttcctatcatttctcccctctgttctgtcttgatgttttccattgttctttattccagttcacactcatctcttcctgtgtctaatctactattaacacttacctttcaggtttctaatttcaaatattttagtgttcagttctagaatttccacttttttaatagatttcagagttttgatgaaattctccattttgttatctcttatttaacattttagtcattgtttcataaaagtctgtgtctgataactttagtatgtagatcacttgtggctctgtttatatcatctgttcctttccttggatttgatcatttggttttagcaggactgggtaattttgactagtgaatattgcattaaaaaaattagaaatgctttgaggatctacccgatgttatcttcctccaaaaatgattcatttttactctctgactagcaattgtggtagggcagatcattttaattcagtgtgtgattgatttgatttaaagttgggtttcagtctttgtaagggctgttctatttatttcacactgctaggatcagccttccatgggcctaactcctctttggaagtccctgaactccaatatatatttcctcgcaattatgaggctactgaaaatcctgcttagcttcatagctcttagctgacatttctgcttggatttctccttagccttttggccctaagcaatttacaaacgagcagatgcctggaaaaaaaagagtgctgcacaatggctggatgaactgaagaagctttctttctcccagaagtctggtacctccaaaagatatctgctagccttagcttctacctggtaccttcgatgtgttttaaaaattttgtccaccctttctagtaagacaattagtctgcagcaaggtactttttattgttacagaaagcagaaccgacttcttgcctcctttttcaagttgccaaaaaaataggagaactcaaaagagtatcatagttctttctccgtacccatgaaattctgataattgccatttcctgcttatagagcacatattataggcaaaattatattaccaaaaaccagtattcagtattataaagagcatagcaaaaactcattggtatctgtaagaaaaagaatagatcaaagaaaatcttgatttcagattctttgggatatcaactcatcactgctgttttctagaacccacaatctttaaactttaacacaattggggaatctctaaacaaaagatggcagggtgcggtggttcatgcctgtaatcccagatctttgggaggctgaggcgggaagattgcgtgaggccaagagtttgagaccagcctggccaacatagtgaaaccctgtctctactaaaaatacaaaaattatccgggcattgtagtgaatgcctataatcccagctactggggaggctgaggtaggagaatcacttgaacccaggcagaggttgtagtgagccgaaatcatgccactgcactgcagcctgggtgactgacagagcaagactctgtcaaaaaaaaaaaaaaaaaaaaaaaaaagatttatgttggtggtgttatacacttacaactttagaggggaaaacccactttgcataataactacttaatctccatgtccccttcaaggtgtttctggcaccccaatactaaattgagtgtgggccctatccagtgagtggtgttcactcacgttggtaagcaggcattgtcagacttcatcataatggctgtttccaacatttgttgctatttatttttttaagttcaggaagccagcctcccatgaaagggttttatgttgtctcaaaattgttgcagctggaaaatcactctcagcaaactcctgaattgaatttttgttctgaagcctgtttctctagatggactatatagctccacctattatcattctgttattctttcaaccatttatttgtatatatggctaattcccccgactagatcacatgtttccttaaggcaagattcatcgccttttagcaggtggttagtgaattaataattgttggtcaacatttccagcagctttaactgcttttgattaggagtggcaaggggccttagaattcatatatctctagatgcttttcattgttctatgctcttaagtgtgacacaaccaacaaaagtagaatgtaaaaggtgactcggttttctttctgtcgcttaaagtcttcagatgctgatggtcttagaagccttagttccatgttacctacaaaagctaaagaggcagacatcacaggtggagacagtacctgctgcccgagaggagattgcggccactgctgctcttgcgacgtccctacaggcccttttgtacagtgtagaggtcctcaccaggtaatcccattggcagaaatagctacagccttacatcatatgtttccactgaaaaaaaaaaaataagaaaaaaatgtgatggataaaaatctaaaacccaatctttatttacagatacctcctaaactcagccctttatgccttataactgtgaacagttcgtgagttatttgaataaataatgttaagcattctgattagtagtagtataataatagtaataatattcttactatcattgctaaacacacatttgcatatagcttgctgagcttctccagcagttataacccagtggtaaacacatcttgtgtaagagggccaatttagtgaatttaaagatgtaatctacatttttattagttattatagtattttatgagacatggaatgcctacaattccaactaagtattcttttattattttactgtttgtgaagtgttgtgtttttaactataatttcagaaactacataaccaatataaacagcagaatgttatcctactgcttgaattaatagattctctgtgggacaggattaaataatgcggagagaggattgagaaatttgggaatggtaaggtaaattggcaccagagttcagccctaaacaaagttcaagcagttagtcctgtcgcaagatgcttgggtgccgaagcagagtcactaagctgccatgtggcaggaaaggggcaggcagggagccctggatgagacaaaaaaataaaatgcaagtggggaaggtggatgcaggacactatgcgtatgatgggcttttctgctctgttcccatctaaattagctgccaggaaatattcttccccaggatagggatggggaagccttcttcctgggtttagtgtctttgctcctccattccattctgccatgctgtgtgtccaatctaaagtgccagatccttagtgtgaaattgtctacgcctccaccaaaaggcaccaactcccccagccccatcttgctgtgctggtaagggggaagccctttagtccaggaaggactttttcagcatgcatcagcaagaaaaagagagagtgggattgtaattcattagcagcaacagatgtttagtttctaatcatgagctacattgccaaactaggcaagcagaatattgcccaaaagccttctgtagactatcatcctgaaatgttcatatgcacctaaactaaggaaatgggaagagttggcacagacagccatgacaaattatctcttccaaggagaaatagttttctatgctattgctgatggtttcatgaaagtcccagaagaatatcctaaagagaaatgaaagacttacactcttccttctgtacccatctggttatgtcactggccttttcctacaactagaagaaagaaaagcagtcaattgttcccaaatgccactgtatttctaatatatatatatatatatatatatatatatatatatatatatatatacacacacacacacacacacagagagagactgactcactctgtcacccaggctggagttcagtggcataatcttggctcactgcaacctccgcctcccgggtttaagcaattctcatgcctcagcctcccaaaaagctgggattataggcatgcaccaccaggccccgataatttttgtattttcagtagagacggtgtttccccatgttggccaggctggtctcgaactcctggcctcaagtgatccacccacctcggcctcctaaagtgctgggattacaggtgtaagccaccatactcagcctatttctcctcatattacgtaatgttaaagctttcctcatttctatacctttttataaggataagtcaattaacttatccaaaattgacttactcgaagtgtcacaaagagttatggatggagctctggcatttaaaattatgtggctttaaatattccagtgcatttaatattcttttggcagagaagactagcttcattatttggtagtagttactcaaaccaaaattggcttcactgtatttacaaaaagaagataagaattctctgctcagggtttctcaaggtggaagtcaagttgtcagctagtctgaacttttatctgaaggcactggggaagaatgaacttccaagctcattcaattttttggcagaatctagttccatgcggctttaggtctgaggtcccatttcctggctggctgtcagccaggcaccactctgcattgagaaggcacctgcatttcttctcacatgctccccctctaccttccaaccagcaatagcatcttgaatccttttttttttaaattttttaattttttttaaattatactttaagttttagggtacatgtgcacattgtgcaggttagttacatatgtatacatgtgcagcgcaccagcatagcatcttgaatccttatgcttcaaatctctctgccctagccagagaagactctctgcttttgaagggctggtgtgactagattaggcctatgcagatactccccctttttgccgtataatgtaacataatcactagagtaacaccaacgggcaaagatactgggagccatctctaaattgtgtctatcacaacaggcacaggaagaggagatctggtgtgatcgttaaaagcttactttctagccatccccagcagacagaaagtgagcaacaaagaagcaaaccttgatgatttcataaaagcagttgctttaaaaaaaactgcattatgcctttttcgtcctagatgccaatacagaggcaaattttacctattatttgaagtaaatctggcagatataaaatgagatgattcaaatctattactaacgatctaaattactgacttataagatactaacttactcactttcctgggtagccttaggtgtgatgtgactaggagaattcttttattctttgatagtttctcagaaaaaatagagtagttgataatggtgtaggtggccaaagtggtacatacatccttgccttttacttattatctagaatggtgaactacccagtagaactgaagaatgacctctttactctcaactggtacagacttagaagtctgtagatatttcataaatgtcttgttggaagagtcattttgacgagtctattactcagaacaaagaagtggaagaacttaaatcatgatgagcttataaacccctgggaatcaatgttcttttaaagtgcctctcagaacaaacagaaaagcccaaagctagacagcctgtcttttgaagactctaaaactaacttaaaacttatgtgtgcttcagtaacttgaggatttaataaatgtttccatttctgttgttgttgttgttttgctgtggtgattactgtcattgttacaggcccatgacagccccacagatgagcaggtgtgaccaaggtcataagggaaccaccacagccaatcacaccatgtcgtctggggtgaacaccaggtaattcactgcgccttattcttctatggtctctcaatttcatacaacccgaatgtcagctgttgagaatgaaaggaaccctgaacatagtcaatattgagtgtgaaaacctccaaggaaaagaaaagaaggtgagagtttagagttacaagaaaataccaaggcttcttttgaaattgtcaaagagaaatctaaaccaacttcataaataggcatttgtgttgttttgtttgcttgagcattctagatgttctctgcctcctgggtggtctttgaactattccagtgttgtttcatttaccttcaacaaaaggcaaataaacaataataatcaggaggtggtttatcattcccagggcactcagagtcaacttactttcatctggacagattttctgcagacatttcatccaaactttgacatatgccctcaaatggtgcttttcatggttgttaacttaatctccttctcttgttgtggtgtaactcagatactggctatactagttaatattttacccgtttcattccatctgtgttagctttaaatattccgacatacacaaaaagcctaattagcttcctcctacaaggaagatttaagatagggcaaacccaaaatcagcttaagaaaaagttcttttcccagtatggaatagttggcctggaaatcataaggagaaattcaataatttttcactctctctgaagcctatttttaagtgtgtatcattattcatgtaaagttaattccctgctcatcatatatattcatattaaaaataaaacaaaaataaattccaaacccagctataaattgcctggtgtgatggttaacttatgcctcaatttcctatattaagggaaaatgatatactatagcttaagtgatatttagggacttctctaggctcactggattaaatgagggcttctaaagaagaaagagggcttctaaagtcttagtatccatgaatcataaagcaataagtctccagaactgaaaggaagtcagccatgattctccttcctgtcacttaagacagagcacatggtattaaaactataacttaaatttcaaaatgtccaaaaatttctctcatttggctatattctatgagtttgtatatatttttataatagtcgtctttacccaaatcacgcaacaataaaacaacttttgcagcagctataattgcaatatatgtgttagccaaatgaaagataaagcctttatgttttaggagtaatatatgtatatttgtgagcttatcaaaatgtatagcttcaagggcttttcatatgaaagtcgataagaagccccaaccaaaggaccccgttcttgctctaatagttatgtagactgtttttctgactcccaggtaccaggaacaaggagccaaactgcactttatcaggtacagaaagacttgctctaatttcataccagttctgacatcttgagatgattgccttttaagctggtttatggctctattagatttcatttgatgcataacatactatttctgggtaaacccccaaaagtgggtttactacagtttgggatgacagtctcttctaggctgctaagctttctttatccttcggatgaggttctccttggcctcaccctactgattcattaactcattaggaatcttatatttttcttcagtgtgataccctcttctcacagctgctacatgaatacattttcagacccctagttaatctttcacaatttcccagggaaaaccttcatttactggaggaagggcaaggcattcccagagaggaactggatgaacgaattgctcgggaagagttcagaagaccccgggagtccttactgaatatttgcactgagttctataagcactgtgggccacggctgaagatcttgcaaaatctggctggggagcctcgggtcattgccttggaactgctggatgtgaagtctcacatgaggtactggcctcgctttccctgccccaagtgtgaacacagcttggcccatgtgtctgaatgtgtgtgttgggttgagagtgggggttctccaggaaaaactcttaatatagaatgatttgtttccggtgacttaggtacacatcatacagaaccctctgctaaagtgtgcattaagtccatcaaacaggatcttagcgtggacaaggggaaaatgttcttaagatagaaaagcacagtttatatatgtgcttctcaataaaagagaaagaaagggaaattttatcacctgaattcttagaaaagtagccttcttctcactactatttactgcccagattcgaatttttcacaagaattgaatgtttcttctctgttattttacatgaggaatgcacaactactttctgcttctagggtccctaaaaagccagtaatgagccctgcagggaagtaagcagttttaactcagccaacttggcttgggcctgaaatcccctttatataaacagccttccaaccgttaaaaaaatgtgtcctggtaaaaattctgaactagatgaggccagtcgtcatttacatgttttactcttagtgtgctagggaaaggccccagaattacttccctgtgcactcgtatttcgtcttcctacagagatgccatttcacttgaaattcatgctaaaggccgtatttgtgtttcaaaaggaacgtgattccagaggaccttctattcagatttgtaattgtttgttaagggtgataaaaatcccttcaaagaaaaatgtcatgggtaacaaaagattcacttggaaattttaacgtatctataaaggtaaaagtagagttaggttcagccacttccaaataacgttgcaatttcacaaaactcacagtttcctggttattgcctttttttaaatttagaaagtactaaatggaggaaaatgagaagacagaaatgtacagtgagcatagattctttttcttccagtgtaatttcacattctttgaattgtgggcacacacccagtactgccctggagaaccccagagcctcactggagttcacactccctgctgtgcagtaatggggaagagcttatttcacactgagaagttcagctcctagatgggagccttcagagaaaggggagggacatttggagtgttaaggtactgctgtcatagcaacttaggaatctattcagcccctccacttcctttcccgctggtcttctctagctgacctaagcaattctgtgaacagagaaacatcacattcccagagtcagaaaatcattatgaccaatggccattttgtgagagaaagggaaaaatattcctaaaagatggatgtgtgtgtgtgtgtatgtgtgtgtgagagagagggagagagagagagagagactatgagatagtgactgtcccataacctgactgtatttatactcttcttagggcatttggagggaggggacagcaagagtcagagaggcctggcgctccctctagaggccaatacctattaaaggttaaatgaactggaaatgatttagctctgtgcctggcacagatctggacacaatagatactaatgctaatgagaatggttcaaatactatgttaaacactggggatgtaaactaaggtcctggtcttcaagattatcacggttcaatgcaagaggcacataagaaaataactatgatacaaagttgtaagtactataatcacatttacatttatgtattattatataaaggatttgaggaaactcagaaaatatttgaagggagagtgtatacaaattatagagtcaggataatgtgaaagattttcaaggagttaattatttttatgataagattagcacgggaaatcaatataagatcatattagatattattcatgaaccataaatttgactttcttagttatcaaagcaaagaatgaaaaaaagattaattacaaaatcataatataaataagttaaaaacaaaacagttgctcggtgaaacaatacttttttaaaatacgaagaacaagaaaaatcttgtaggggccaagggaaaatttccccttcactctctgaaggtttgctgaaagtcaactgataaaaggcagatcataatcaaaaagcatgaaaatgtatttgatcatagttttacctgacacaggagccttcaggatgaagacccaaaaatacaggggaagctctccatttttgtttaagtttaacaaagtatggatagccatgtataaatatgactggacaaaaagggtatgatcccattctaatagaccaagtgaggaaacccagcatggcctgtatgtttggattcttcttggcctctctggttagcattccttccttctgggaatggggcaagaccctttctggaaagggggcgttgttatgacctacaatcaaacaagatgggtcaggtaatttctttatggctagtttttacacagaaagatgggggaaatttagtgtaatatttttaagttttatggctggcttcaggaaaaaaggttctggtttcaatgacttgctttgaggaaaagggtctccagtttccatggctagccttggaaaagaatgagaggccacagagaggagggcaggagaagatcagtgaaaaaccttggcttctgaggtcttcattttggcgtattgctttctgagcttcaacagtctcctggttggtgtttgttaaaagggaagagtagtatgatgaacagagtcctcaacaacatccccatagtagataaagtgctggttgtacatggctggatgcctgttagtatataaagttggcacaatgtcataatgcagttcagcaagagcaattgatctgaagccaggataatgtcattcaagagcacagctatttcatggcctggatcaataggagggcaacatttttattgctcagggaatatttagactaaatgccctttattaacgcaatttctcacaacaagcttttgaaaaagacaggcctgccatagtctctgaccaaatagagacattctgtgttgctgattaggggcagatccagatgctttgaacttatactaagcaaaggatgtaattaaggctctcctataagttaagtgcgcacttgaatatgtgtaaaagttggagcttaatatataaatttgcgaattgagggtagtattaaatcgttcttaaattataagaatagataatgtcacccaaggatgaaaagttgatttttaaaaagagaaagagaaatgggatgatataaaaaatgcaaatgtttgccaaaataatttgaatcaaaccaacaagttaagaaacattgctaaggcaatctatacttctgaatttgcagaatgtatggttgattacaaggctcttgaagaaaatattcttgattagagtctctgccctacagaaatgtattgcttcatttgtccaacccagtgctgccaaagcagctggataatagaatctgcaaattctctctctttttctctctctttctctgtctgtctctctctcgtgtgtggtctctatctctctcattctctttctctctttctcttttcctctctccctcaccctctcaatgggaaaatctcttgtgttcccactgggaaagaaccataggaaagttttttgattatacatgtgatagtacagcaaagactgtgggaaagggaaattttgttttatgcacaaagcaaatttattttgtcacatgaccaggaattagagaaattcaggtagtaatccataaaatggctcttaaattcagctctacgtagtctttggaagctcaaaatagacagattgattatctcacaagcacttctcaatgttatctttaaaataataagagaaaagaaataagtgcatatagatatactcttatttgtcacacaaataacctgagaagtaaagaattattttctgtatatcaaattcatgagaaagagataaacaaaagaatgtataagctgtttaaaatgatttctttaaaacacccacattcacacagaattccaggacaatgtgaatatgttcagtttggagagaagacaatgggaattaagagacaataactatttcttgataatgaagggtcatgatggagaagatggattggatttatgctttcagaattaagcctagtaggaagaaatgaaagggaatttggaggcctaacatgaaaggaacctctcacagtgtggacctccaaagatgaaataagttgccttgtacagtagtgaattttctatccatggagccagtcacataaagcaattgtagaacaatctaaataatcagagaggtagtggccttggctgtgattcctaaaccaggatgcctatcaaaatcagctgaggagctcttaccctctagatcctttcaaacagttattcactcttcagttctcttggagtaatcacaatttctctttattacaatgctatagttaatatgtgagacaaagaattacatgatattaccactgcactactcctaatgcatcagtggatctgtgcagtgactaagaacaactaatataaaaagagtgacaactaggaatcctgtacctcctggcggaagtacacaccacatacaccacctgctaagtactcttgccaaaaattcaaaactgagtctgcagatgtaggccctggatttaacttccaatcgaattaaatacaaaggcagtaggatagattaaattacaccgtggagattcaatcagcaaaattcagagtgttgctacagagaatttctttaataaataacaagataaggccgggcgcggttgttcacgcctgtaatcccagcactttgggaggacgagttgggcagatcacaaggtcaagagatcgagaccatcctggccaacatagtgaaaccctcgtctctactaaaaatacaaaaattagctgggcgtggtggcatgcgcctgtagtcccagctactcaggaggctgaggcaggagaatcgcttgtaccgggaggcagaggttgcagtgagccgagatcgcaccactgcactccagcctggtgacagagtgagactctgtctcaaaaaaaaaaaaaaaaagacaagtacagaaggggggaaatcgacatattaaaagagacttaaggacatatcaacaaattgaaatttatgggccttattttttcctaatttgttaaaaaaaagtaattatgagataatgtgtgaatgttgaaaactgactgaatatttgggttttttaaaaaagaattatttttaatttgttaaatgtcatactgtgttgtgtttaatttttctgagtccataaatttggagacacatactgaaatatgtctgggtaaatgatgtgatgcttggaatttactttaaaatagtctagggtagggaaaagggggagtgtttgggggtataagtaaaacaagagtcactgtaggccaagtacagtggctcacacctgtaatcccagcacttttgggaggctgaggcaggcagattgcttgagtccaggagctcaaaaccagcctgggcaacatagcaaaaccccatctctacaaaaactacaaaaattagccgggcatggggctgtgcacctgtagtcccagctacttggaaggctgaggttgagagatgggtattttggggcttactatatactgatctctctacctttttatatgtttgagattttccaaaataaaagttaaaaatatacagatttctgggcccagaccagaccttagaagttttttgtttttttttttttagacagagtcttgctctgtcacccaggctagagtgcagtggcacaatctcctcagcctcccgagtagttgggattacgggtgcccaccaccacgcccagctaatttttttgtatttttggtagagacagggtttcaccatcttggccaggctggtcttgaactcctgacctcgtgatccacctgcctcggcctcccaaagtgctgggattacaggcgtgagccaacacacccggccagaaggtcttatttatgagatttttggaggtcctgggaaactgtattttttcgttttccttttaagctgtattagaaaaataataataataagaggtgccagtgtgaacctgactgcctacaggatattatgactattatgggctctttcaaccctaagattccatgactcagagaagattatcttcagagcttttccagtacaaacttgtctcaaaaaaaaaaaaaaaaatcttatttttccatttatctcaaatctcctcctctctttagtaacaatcctgaaaactttccatgtatggctgcccctgctgatgccatccacacatgcattcctaggtaacattaggcctctctgctaccctcgtccatcaggaatcctctgtcctacattccagttccataggatccttttcctgcctaactcaacatgtactgattcaagccaaagattcaaataatgggtggtagtaacttaatgtattacccttcctaaagaaatttgttttcaaatgaattttcactatcttgacaaagaatatgaacatttcagccactgtgtcttaggagtattttttagaatataagcttttttttgaggaaaaaaatcaagctcgaatcatacagaatagttgtaagatatttttatgaatgagtatacattacctcttaatattatcttgtacacattctgcatctactcggtatattttatcaggagccactgtaaaatgtttaaatactttctccttcatacaaaattaaattaagttggctttaaggctatgtacatcattgtatttgtattatttggaaattggtaatccatatctagttctgaagattatttcattaactattacatttactagaaacctcattttcccaattaatctatttggccaattctccttcagaaaatctgacacttaggacatcaacacttgggtctggtgactgcaagcctgggccaaccttgagagaagcacaactttccctctggcagttcctgtatggaaccgagttgggaaatctaagaagtagaggcgaccaaaaccaatgtcattcagacagtacaactgggtctattatatgaagaatctcaacagagagaaaggatccatgtataagataacaagagaggaggaggctttaaaggagagggatggaaatggagcctgaagaaccccttgggttgcaacaaaaaccaagagcactttttatagggtggctttgaccttgactgtgggtactgagggagttctgaagccatgaaatttacaaggacgtttgatattagtaattttattgttcattaaagttagttctcttttatatgcatatatgtcatatttataatatacatgtatttgtgtgtttatatgcctgtatatatacacatgcacattctcagaaatgacattctctaaatatatttggcctatccttaatctctctggattttagtttcctcatcagatgctctttacatgttgtctctgaagcattctatgattctctattaatatgcatatgtaggtatcactgttctgatgtgtgggagagcagagggatagaggatgttgggaagaatgttcttagttcagggagttggtggtctggaaggggtgattaacatgttgctgtgtaaaaaaattcctgttgtgtaattctaagcttatactttaaaatatatatacatatatatatattttaggttggcagaaattgcacactcccttctgaagctggcaccatatgacactcagacaatggagagtcgtgggcttcggcgctacatcatggagatgctacccattactgactggacagctgaggcagtgaggccggccctcatcctcattttaaaaagattggatagaatgttcaacaaaattcataagatgcctactttgaggtgagaatgcctccgagttagctgttgctatcacaaatgtcaaagttaagatttgtcattttttaagatggtggatcattctggagttgaatggatgacttgaaagttttctttggtatatgtgcatagttaatagggtctatgaatgcctaagtagcaaagcctacattttgagaaaaataacattttctttaaaagtatatgtgctcatcttgaaaaaaatctatccatttcttagctatcatgctcctcatctgacacatataaaaatttcaattagtaccctttaatcccttttaaaataagggagggttggccttataaatgaaacaactaatgagaaaagaaaaggaattttatgttcaaaatactatatttaacatagctagttaacatatttaggtaccagtttagagaaattccaagctttacaataatcgccaagcagaagcttaaaaattcgcaggattgaaaacaaacacctagttttcacttttttacctaattcagtgtggtactaaatgaacactattaatgcttgatctttgttcagtgacctgggaaatattaattggtagcctacatattagcagatgtttttgaaccactctacttagagatgtgagccgagtttggaaactgtagtgatagtgagcagatagttcaacagattaacactggtaaacccacttactcggaaatttcaagtttaggttagtgagaaaattttctgtccttttaaactaaacccaaaaatcagtgtgactccttcccaagaatttatagcacttaatgttcaattcatcagaatttttcaggtattagtccataatctccttcacactaatccagctttcaggagtcattaaaaaaacaaatggaaaagttttattctaataattgattatttgtttttatattcttttataccgtggtgatgactacctatacattatttcaaggttatttatttcaatggcatggaaatgcttgttttaaaacactatttctttagtgatcccaatagaacatttgtgtctatcagcaaatggcttatcaaagatttataactgtctcacaagggtgcgtcaaaataaattcctttcttaaatacttcatatctaaagacgttaaacatctccaaaaatgacccatttatgcttcccgaaagtagatttctggattagtacataggcttggtcagttataggcaattttctcgggagataggctatgaatatggagttggcttggatttaaattcattaggtgatctcagttcaacacaagaaatgttgactgaacctgacctgcatattaccttcagtgtcggagatgtcacatagcctcatttatgaatacatttccatttgtcattgcagattccatttcgctagaaaatataagcttagaaagtattgccaggaaaatataaggaaatactgttaatatcagtaaagcccaagctgtttattttggggccacagggatgaatcagtactagaagaattatgaaatggattgacttttattacagaaaatcccatattcatttaattgggttatgtatacagtaacaccatttatactaccatagaaagtagccaaaaaatacatatcatgtcttgggaggccaagaaagaacattgtttaaataaactattttcttctaatgtgatcttcttggcaggagttaagctatataaatcaaattagtggtagtctggtgtaaaaactgatgggcgtgtgtaatctgataaacaggtttcagaaatgtagctggggtcagattagttctattgggagtaattacccctgtgatcagttttctatgatggtagtcttaggaccctctgtcaaagctaaaaccagggaaattaaaatgcaacccattcatcatctctgttttttcttcaatagatttagtcgagtggggcaggcctgcctctgctacgttttcagtatcttcttcccctcccagtatgctctgtgcttttggaacaatatgggtaaacttcatcccagagacacatcctgtcttagatggcatcagaatcactgtctcattcacttgtttcagactctccagaagggagccaagacgctaatggcgcctatattgtattccaggcgacaggttgagtgggagcctgccagcaatttgattgaaggggtttgtttgacacttcagaggcagccaatcatatccttcctgcctcaccttaggtcactgatcaatgtctgtgtcaatctggtgagtagccaagtggcaatcttatgaaactttgcacaatgtaactctgctattgacttctctgaattgaagatttacaggtcaaccactttgtgcccctatctgcccatgaaaacagacggctcaggtgacactgaaaatagtgaggtacatttcaaggtggtgtgtggggagatccaggaacccatccctacacagaagggattttggtgtgctgcttcccatgcactactttgacaattcacctcttcaagttgcgctgagagttgagggctgccagttggagagtggggtggcggagcctgcacaattggctagaagttgaggtagtctggggtggggaacttaaaatgcaaagaggatatttttctcttatggtgcaaaatgacactatgagttggccagtctaggatttatgtgaag

SEQ ID NO: 12 - DNA, 40229 bp, Homo sapiens
gctccctccctagatcttccatccaggatagtcctggaaatgatcttgatgctatctgttcctcgttacagcagacctgctcaacttcagcagctagaaggaggattgtctttcaccagctgcaggagcctgttcccactacagtgagataataatttcgtttttttcaagccaagaagtatttattgaaagccagctatgtgttttgttttattatctcttgatttaaaatctagcattttgctgctgtaagggaacttagagttcttctatctatcattatctccagttctatttaatagggagagatactgaggcttagagaggaaaggttacctggctaatactattcaccgagtttgtagcagcaaccgtatttaagaccagacttcccagctacaaaccacctccttcacgctcagtggtgctccaaggcagctggactataagcatctcgagcacacagatgtggtcccattcttcaagtcttgacatagcaaaatgcctttttagattctctaagagatgtgcaattgattgatgagtaaactgactttattttttaaattctgatttaaaagggtaagtatttgactcagaaatgcaaagattttcttttctttaggaatattatgaatttttaattcaacccagtattttcgataaaatttaagaaaatgaaacttccaagaattgaataacaatctcttggaagtcatatttaagtgctcatttgtgtctttagcaagtcatgggtatgcggcatatcagaaatgttcgtaggaggtttaattcttacaacactgaaattgtttttaatgacatgctaaagcatagttactgtgaagactcactcatgttttcacaagctacgtaggaagtgccttttacatggcaggcactgttccagctctggaagttcagcagagaacagaaaagatagaggccccagaattcacaaacttatatgctgatagcagcagacctacaataaaccaaaaaaataaataaataaaataaaataccacagtatgcgggaaagtgatcggggctgtggaggaggaacagaggcaggaaggaggacaggaagcacttaagggaaaaggctgcacggccataaaggatatgtgcaggaagaaaaggccagtgcaaagaactggagacaggaatatgcctgatgtattggagaagggcagggaagccagtgtttctggaagggcgtgagcaagaaagaaaatgccagcagtaaagagaaggcccgagactatgttagcagttttttgttttggtttggtttttgtgttgttgggttttttcttgtttgttttgtgtgtgtgtgtgtgtggttgttgttattgtttgtttggtttggtttggttttgcatagccaaagaagagagacactgactttagtctctgcaacaggttcaactcttatgaaataatacatggttttccttttgccaatgtagaaaatacataaaatgtccaggctgctaattgagcttcaggacttggtaacaggggaaaactgtcatctcagaacaagtaaagattgattaatatcaaaataatttccatctcagactggaaattctacctatctattggagctgacaagcaagattgatcacctaaactaagttaatcataacaaatgaaaatgttgaggcacctataattaattactacccaaatgagattcccatctttgctagagataacccctgaatatatcaggtcatccatctttcagttcttctattagagtcataatttcattttcctgctggttcctctcagaacccaccacgtgactatgcaggcaatgtgtgtgtttttcccttcagtttttaatataattatatgcaacaaatatgcaactaaagaaaatgttgagttctaggaaaatgaacgtcattctctacttaaaaactggtgaaatggacattctctatttaaaaactggtgaaatgactttgaaattcatgatttcttttgcactttctatctttctgatctttctcccaaacactgtgaattggatgtttttgttatcattattattattcataccttacatgtgagatatggtggtcaaagtgtttaaaaacttctcagtcctcttcacccccatcaaactgcaatttgtttttaacttgcttaatgtctgtgtccagcttggtctcattcactattttaaacccagaaataagttctgtgctagtcatagaatggcaaaataaatgtttgttggattgaactgacttgatcgccatggaaatcaattatggggagacctgcactagcaccccagctttaccaccgactttgtgtccctaagcaacttctctggttctgtttccacatgtgtatgacagaaatttcaaccttgttgtacataacttcattttcttaagtgctggccttcataacaatacagcagaataagaatcattgctgccatttttacagatgaaatatagagttgtctggggcatatattataataactagaggttctgcagtttaaattcctccacatgcctttgtatttattcacacaagtagaatcaaattgcgatttccaatattcttgaacaaattgttgcaccttgcttagaaaaaaaatctgtacttgaatgctacctccctgaacccaaccctttctggacatgttattgattcattaaggacttggattacatagacactcaacatttaattgcattgctatcaaacatgtatctaacaaaataatatataaggttgtttaggtttctaactgtgtaattatactgttctatgtatgtagagtttataaaaccattcacatgttacagtagccgtgttcatcaaagctctggaattggcagctcctttccatatatgggaacttgatcaagtccttttgctgccttcctcatacatttcttaagagcttgaaattatcaatgtttgcagtttatagcacaatagcaataagaagtaagtgcttatcaaatgtcagtgtagttttcaatatcatcatgtttgtcatcaatgtattttttcttcctaagagcctggtggagtcttcggagcagatgtgactgtcctacttgtatagagaagagaaactgaggctcagaagagatgcctggctgagtttaataggactgcaacaacaattttgcctttctactttctggtacagtggtctttcctttgccatcatgcctcagcatatccatgttagtaaattctcccagttggggaaaagcttggcagcaatgaaagttaatgtgatgaatcatttagatggacagattggaaaaatgttgttccttttgcatgtgatgttcttgccagaaatcaagtaggtggagtttttgaagcgtgatcagttagataagtatggtggttttaaataatcaagcatggagccataccggttatgtttaatttataacaaaatcagacaattcaggcatgatgttgaactcattgagcttggctcactactacatttctctcaccaaaagcaatgactataaagagttacaaataccatgaccttatatcataaagcataaattattccaggaagttttccatttaagtcaacttctcaaaatcttaggagaaaactaccaatattcagttcaaaccccagaggcttaaggaaaaatattaatgttgaaatagcaagtaagtggtagtatcctcgctgtatgcacaattgcatctgctcgggggttagtctttctttagctcctgtctacaactcacaccagtctccataaaagaaatgaggtctcactgataccatctagcttaatgagataaaaatcctggtgatctctgcaagaaaataaaactaagataaactagtatctgctactgataaatatttaacagatgtggtccaaatccctctgccagctggaggaaggaaaaaagttctattttactgcttggatataattattggccacatttctccaagcaaagacagtgacattggctcactccccaggagaactttcttctgatcttggcactaggatttgcttttctttaacagattgcagcaatatacccttcatttgacccagtttattcattcaaaagatacctggagccaaaaccatgtatgagaaatagcaaaggaagaggcaggcacaagctgtgtttatatacccaccaaaggactacagcaaaacacatatattctagtcagctctgagtgcacctgtctgtgtcaacagtagaccagcgtggtctggcagatgaccatatgacccagctgattcactccggagttagaggaacttttcccagaccctgaaagtcacctttttagacaacttcgcaaacagccatccttgttcacggtatcatgccccttgtcactgctaaacagaccgtttgcaaagaaatttcctaaacatcaccactgaggctccttccagcaatgactctggtccatcattgggattgctgagcagctgtttcataacatgaacaaggatgttttaaccatgtttcttgacctggccatttggatcccaaggatgttttggtccaagaataaattccagagcttaggtaggttacataccacaactatattcatttcctacttctattctttctctgtgcaatccttttcctagcactgtaactgaaagtatttttctaaaacattaatgtgatcatactatgtctctgctgaaaagccatcaatcactatctacctattactgacaaaaacatgacattctgatcccacctgatctgctctttctcatcaacaactcttctccttatgtaatttctcacctggtgaccaaccacaccctgcatgtgctatacattcatttatgctttttcacctgctcaaggcccccagaattattttcaagtattatttttcccaacacaaagcatcagtcgatacctgtagtaagtctgaagcatctcagaagcatttattgacaacccagtcttctactctcctctgcctccaaacacacagcacatacattttgtcccaaacatttgtaggccatcattgtcttttgcctggcatttctttactaattaatatatatttttattcatgtgtgtatatttatctcaccaatatttgggagcagagcctatgtgttattttagttatacaggttgttgggtgatatggctgtgaacctgatatgctatagattataaggggaggtggaacctgtcacacttcctcttcctccatcactggttgtctgtctcaaagctcaccgaagaagacaggaaaacttgtcagatggggaaggatgtgtcaagagcatgcacacagatttactcttcagctagaagctccaattcctagatgatctgaatccaactcagagtgcttgcacctgtttcctgccacacagctagagctggtgagtctgatttaagtaattctacaggaagacaaggcttacataagaataagtagtcgagtagacagatatttcctccatggaatctgccttgttcagaaacaagtttaatcagttactgacttatagtaagaatgtgaatgtcataattttattaaaagtttttataaataatttcattgtaatttaagcatcgatgaaaatgtgttgtatatggtcatgtacttgctttgttttctttttgtttattctatcgacttttacgaagcacttacactgtgcatgaagacacatgggatagaacactatccctgctattgaggaatcccctgtaaccatttcagtgacagaacagctgaagctcagtatggtcaagcgactggccactggccagacctgattgtcatgaacttcagttaaggtcctctgattcccatcacagtctctttccactccttatgctgtttcatggcccatgttcagggagtgactctggtctgcctggatttctgaaatcttatacggatggctggtgagcttagaataaagatgcaacatgaggaggcgtacctgtttcccatatgacttccaggaggccaggagagcagtcttcccgagtcaggcaggagcactgtgcctaaagcagcttcccggggagagcagtgacgttcccggtctcagagaatatctgaaccccatcgcccccaccagtttacctttcaaaatgcttctttccactggcacgcagtgctcagtaagacctcacagtttccctgggctgtggtccaatttgattacctcctttttccatgcttggaagctgctatgcaataatctttttaacctctgcaaagccaggacaaatgtgacagcaaaagcaatgttagtacttgaggacgttttctccttttagattttgaggatttatttcatgtttataaagagagcagaaaaactctgtcactttctgttggtgttatcctggtcatctcagagctctcattaactcttatcctacccccagcagaaactagagaattctgaggaaaacacactttcacttcatggaaatatctcagccactctttccagcgttgcttttccttccatcctaaccatcttgttttgatcttaaatatcttcagaatctgacttttgaaatttatttttatatctctttccagccacttttgattaatctctcaatagggtaagcaacatgattttcttttcttttttttttttttttttaaaagctccagctctggcttctggctggagtgcagtggtgagatctccacttcccaggttcaagcaattctctcgcctcagcctcctgagtagctgggattacaggcacctgccgccgtgcctggctaattttttttttttttttgtatttttagtaaagacagggttttactatgttggggccaggttggcctccaactctggatctcgtgatctgcccgcctcggcctcccaaagtgctgcgattaaaggtgtgaaccacttcacccagccaattttaattttaaaaaattcttgtaatagttctaaaacaccctgagtcctgcagtcttcagcctttgcatgaatttcctcaccaccatgacaggcagggccccaaagtttcccagctgaatttcatccagtatgttcctttctaagaggagagattagacaggcacagaggagaataatgagctgtgtcagactaaaagacttactgaaaagttctaattatttttcttcaatagactaagcattttagtttgttttttgacaaatgtggcagaggtcacctaggtgtcccacaaacatgtttcctcttgttccaaaagccactacttgatatttcccagcctcccttgaaattacatatgaccacatgtaacttatttaaccaatgaaaatgtagataaaagtaatgtggacaacctgtaggcctgcgttataaaagctttctacaaacagaccccctgtctctctcctttgcccacaggctgattcataggactttattatgctggggaatggtagaaaacataaataatagatacttaggtaggtctttagtttactattagaaagccatcacttattggactttaggtggctgaaaaataaactgatcatgttaagctactgaggtttgggggtttatttgtttcagcagcatatgttaccctcaactattatacagatagacaccttggccttggcttagtgattggtttgtgggtggcaattgtgtgcgtgtgtatatatatatatatctgcagtcttctggccaaacatatatatacacgtatatatttatttatatgtttaaaggctgcctcagatatatatatatgtatgtatgtgtatagatatgtatgtatgtatgtgtatatatatatatgtatgtatgtgtatatatatacacacacatacacacacacatatatatatatattaggcaagaagactggaaatatttgtttttctatgacaaacattggtaagtaattgctttaatttagactacttgatttctgtaactctcagggaaagtagttggaaaaagtcacagtgactgtcaaattctattgactgtatttggcacagtattacaaaaaaaggggagctcaggcaagtattgcctgacttttaagtagatatccaagacaactggaaaaaatccaaaggtccagagtcctacagcattgaaaatgcaggctgctaccagactccaaatagcaacacataagattgaaagagatttttagtgactggagtccagtaagtctttgcagttgaactaaataactccaatcgggggcagcctttaatgcacacaatggccttcccaactctcatttcagatagcattgaggtggccaccattaagtttggaagaagaataggaagaggtcgaaaagcaaagaaatgagaattatgtctaagaaaggactttgtgtttataaggacatagaattgccttgaagaaaatctggaacagaggttgacatagtttgaatatttgtccccacccaaatcttaagttgaattataatccccagtgctggaggtggggcctggtgggaggcatttggatcatgggaatggatatataacatatatatcatatatagtacattgaatatttgttcagtagtcattttaatttgtttttgtttcattttgacagagcatggggaactggtgacactaatatttccaaagaaaccagtctcagctaaatttgggggaatcatgtacaaaaggaaattgagaatcaacattatgtgggaaataaatttgccatcagtaaaagagagaaataattataatcagaaataagctgttattggaataacacccatagaacaacttcttatcactgttttcaaggagtaaaggaagctgccttttccttggttatacaaagtcaatgaaacacacacacatgcacacacacatgcatgcacacaaacacacacgcacattctggtgaccaatatgtccttcttgttggaagtcttcagaatttagatcacgaatgttgcccacttgtaaaaactctagagtatcatatggcagtggcttagtacttggaattttccattagagttagttactgtctaagcattatccgagttgtgtgaaatagtttgtctacaattaactctttagtcattcctgaaatgtacactggtataatattcgtgtcattgaaattagaaagaccactacaatgatgacaatgactattacaatgaatataatgacaactgcgatcacttcaactataactacaactattattattacaattactaatgctagtgtaatattgataataatgataaggtctatgttattaataatgataacaacagtcaggtattgtgctgttccctgcacatccattaacttatgtattcctcacaaagcctttgtaaacaatattatgacttttgttgtaaggaagaatataaactccataaaaatagataacttactattggtgtatctctagtgtctagatagtaattgatttaaaatatttcctcaatgaatattttttcttttcatttcttgctggaaaataataataataataattattattattattattatttttgagatggagtcttgctctgtcgccaggctggagtgcagtggcacgatctcagctcactgcaacctccacttcctgagttcaagtgattctcctgcctcaatctccccagtagctgggactacaggtgtgtgccaccacccccagctaatttttgtatttttagtagagatggggggtttcaccatgttggccaggatggtctcaatctcttgaccacgtgatccacccacctcggcctcccaaggaaaactaaattttcttaataataaaataagttgggaagagggaaaagaagatgggctaaaaagaggcagaggaggattagcaagaagaagtagggaaggaaaaagagtagaaggaggaagacataggctaatatttgagcttttggcatttcccatgtaacgtgccaagactcacacattctctcattttatcctcacaactaccagatatggtacggatgttttattaactccattttcatacttaaaaaaatggttcttaaagactttgactaaattgctgaagatcacacagctttgaatgttctttttctgatttagcttcctgggtacaaagattaaaagcgctctttggttgtagtaacaacttctgatcttctagagaagttattttggctaaatttcctctgaatttccctttctacaacttgcttatttccaattttcatatgccttaataatttaagttgttttatatatttcttggaaaaatcaagactattataaataaattcataaaagtaaatcaattaataatctaagaccaaatattataaacaaataaaataataataaaagaatccaataataatctgcaggttctacattaaaagtaaagcaaatgtagaaggtgagttttacttccttgatttttttctgaatatgtatcttcaggaacttatttctcagtaagcttaagtataaaacccagaatttcaagctcccttacaaagaaaatgctgataatttccagggaagcccagccatcctctgaatccacctgactgcccagacaccatccagccttctgctgaagtacttctttcccacatgtgtttatgaacctgtatttctctcagctctgaggtacatcctgagactcacatgtgttctacttaattctactacatggcaagaggtcaacattattattggttctttcctctctaagtcttaaaacaaccacacttcaatctaggctagagttttaggctgcattctattttgagacacacactgtcagtaaaagcttttaagagtaactggtaattatgtatcacatatagttgtgaaatttaatttgtttgagcaaaatacctaattgtctcttttttataatatttctctttatgtaatataattgttataattacatttctactatacacatacaatgattttaattacacaaaaaagtcatatcttttcataataaatataattaaacattcagtgtagaagtatatgatgaaatatattttataaatcagagaccataagatctttatgtgttaatgttttatgattcctgaaagcctaaaacagttgagctaatatagatctacaataagtgatttgcaatgcatttgtatagaacaaaacctttttgctctttaaagtcatttcacttttaagtctttggacaccacaacagtttgcctgatgaagaataataagcagtcatataaactaaaaaggtcaattctgcacctacaatttccttagcatgtttaggacaattaagatacatagtatctttgctgtgtatgcatgtatgtgactttgtcattgttttgctgttgtacttatcaatttctctcatcaaatatttacatggcccaaatctgacatggcttgtaggctcacattatcatgctggtattaggaactgggtctccctctacattttgttatgacatctgtatcccagtcatactgttatgtctaccatttcaccaataagcctgaactacctcagtgtctttgttaaaagtttatttctttttattcccaaggatcaatttaaatattgtgcctcccagtgagctttcttggatatttctaatcatgaacaacccatctacttccaataactctatgacaatatttttatgtgtatctacttatcacattctcttcactaacctgttggtgtaataaattctaactaagatagtggaaaaaagggtatataccttttttttccaaatctgtgctagtcaccagaagaggtgactagcacagatttgggaggccaaagaaagcataaagaataatttatgttcaaactaacaaaggaagaatgagaagaaattagttgggtatcgaaggcacgggcaagatagcacccaagcaaatgggatagccttaggaagacacagaggcatgaaaatgttacgtagctgactatgtgaatcctccatcaatatcccctaagtccttataattgccacagcctgaaacactttttcaagcatctaagcctgtatctttctgcctggagactatctctggttgctggaatctgttccgcctgtgtgcaaatggctggaaataccaagaaactaatccccctcccaggatttagtgtatggatatcctggctctcttgcctctgagactggacaactcaaatgcatgtgttctacactggaccccagagctccacagttaggttaagctttcaaaaccaacagcggtagcatgttcactaatccatccattactgactgctttccttctttgtcttattttcctattacctcactggtgatttctgacatcaactccctattaaaatgtatgtgtgatagtctgaatgtttttgtcccccaaaatttatatactgaaacctcaaaccccaaggtcatggtattagaaggtgaagatttgggcaaataatcagtccccttaagtgagattaatgcccttataaaagaggcttcagatagctcccttgtccattctatctaccatgtgaggacacagtgagaagttgctgtatttttttttaccataaaatgggccatcaccagacaacaaatctgctggtgtattgatgttggacttcccagctcccagaactgtgacaagtaaagttcagttggttataagctaaacagttcatggtaatttgttttaagaaactggatggaccaagacaacatgtaagtaaacccttgtctcaaggtctgcttttggataaactcgaactgagacaccatgccataactgatgaactgaaagaagttcaggttggttgaaacatggaaaaaatggaataaaaatgaggagcatgcatatagaaaggtaacaaccagtgtgtgcaagagctctgaatagagtacatgttatataattgatctgaaaggcatttggataccaatgttttactaaaaaagaggggtacagttaaacagtacatttgtgtttagaaaaagtattattctggccacaagaaaaaaatcagtttgtgtggggacagcagggacaaaactgaaggaatggtgataaccttggaggttttaaaagtgaccaaggtttgaattaataataatagcctgaactttaatagtggaaaagtgaatgggggaaatgaggtgttttgatagagatttagttaatgtacattcaaatgacactgataaaactgagtgacttgatcaaatgtaaagagcaagaaatggacatctactctgcttacagcatggtgactatagctaacaatatcgtattgtacacttgaaacttcctatgtgggtaaatcctaagtgttctcatcaccaaaatgtaactgtgtgagattctggttatgctaattagcttgattgtggtgattatttcacgatgtatacatatatcaaaacatcacattgtacaccttaaacaggtacactttttatttgtcaattatacctcaacaaagttaaggaaaattaaaacaagaaagagggttaaatcaaataaaatttcttgggagctggtttggggaactgggtggaaggtgatggcattttttgaagtatgaaacaaaagaggagaagcaggtcactcaaaactttagccaaactgaagaaaatgttttgtttgagacaatgaatatgaggtcctaattgaacttataaatagatagattagaaataaatagacatatataggcatacctcaaaattgtggatttgggccaagattactatataaagtgatgattgcaatcaagcaagtcacagaaatttctgttttggtttccccatatatatagaatttatgtttatgctatactgtactcttctgtgtgcaatagcattatgtctgaaaataattcacatatcttaatttaaaaatactttattgctaaaaatgcctgcaatcatctgagctttcagacagtggtagtcttgttgctggtggagggtcttgccttgatgttaatggctgctgactttttaggatgatggttgttgaaggtcagggcggctgtggcaaatgcttaaaataaaacagtgaagtttgctgcatcaattgactcttcttttcatgaaagatttctatgtaatatgcagttttgtctaacgtcattgtatccatggtaaaatttctttcaaaagtagaataaagcctctctaaacctgccattgctggacccactaagtttatgtaatattataaatccttttttgtcatttcataattttcacagcatcttcaccaggagtagattttacctcaagaaaccactttctttgctcatctataaaaagaaactccttcatctatttatgtttcctcaggaaattgcagcaattcagtgaaatcttcaggctccacttcaaattctagttttcttgctatttatacatctgcagtgacttcctccagtgaaaacttgaacacctcaaagtcatccatgaggtttgaaataaacttcttccgaactcctgttaatattgatattttgacccccgtcatccccgttaatcacaaatgttcctaatggcttctagaatggtgaatcctttccagaaggttttcaatttacttttcccatattctttacagaaaacactatctattggagctaaagcactatgaatatatttcctaaataataagacttgaaagttgaaatgtcttgttaatctatgggctacagaatggatgttgtgttaacaggcatgaaaacaatattcgtctccttatccatctccatcagagttcttgggtgactgggtgctttgtaaatgagcaggaatatttttgaaatttttttagtaataggtctcaacagtggtcttaaaatattgagcaaatcatgttgtaaacaaatgtgctgtcatccagactttgttgttctatttatagagcacaggcagaagagagttagcataattcttaagggcagtagaaatttttgtatggtaaatgagcactgccttcaacttaaagtcatcagctacattagctactaacaagagagtcagcctgtcctttgggactctgaagccaggcactgacatttcctctctagctatgaaagtcctagatggcatatttatacaacagaaggctgtttcgtctacaccgacaatctgttgtttagtgtagccaccttcatcaatgatcttagctagatcttctggataacttgctgcagcttctacattagcacttgctacttcaccttgcactcttatgttatgaagatgatttctttccttaaacatcatgaaccaacttctgctagcttctaacttgtcttctgcagctgcttcacctctctcagccttcatggaattgaaaataactaaggtcttgctgtggattaggctttgacttaagggaatgttgtggctgctttgatattccatccagaccactaaaatgtttgtcctatcagcaataaggcaacagcctttttggctttcttttcatttgtgtaggtaacacttttattttccttcaaaaacttttcctatgcattcacaacttggctaatggtttggcacaagaggcctagcttttgacttatttcagcatttaacatgcctacctcaccaagcttaatcatttctagcttttgatttaaagtgagagatttttggctcttcctttcacttaaacatttaaaggccattgcaggcttattaattggcctaatatcaatattgttgtgtctcagggaatagggaggccagaggagagggagagagatgggaaacagctggtcaatggagcagtcagaacacatacaatgtttattaattatatttgatattttatatggacatgcttcctggtgcccaaaaacaattataatagtaatatcaaagatcatttattacagatcacaggagatattaataataataaaatctgaaatattgagggaattatccaaatgtacaaagaggacatacagtgagcacatgctctttgaaaaatgattccaatagacttactcaacacagggttgccacaaaccttaaatctgtaaaacacacaatatctgtgaattgcaataaggtggagtgaaatgaaataacacatacctgtatttaataagatttatgagtcacaagtccagcaatataatgtgagctggagctctagatttaagaattatttatttacatgttaatagaagccatgagaattatgatttcattcgatgtgattctgctgagcagcacttctcctttgattatttctgccccctagaggattaaaaaataataataaatggagtgttttctgaattttttttttaattccccttgtcacaatgatgaggagaagacatttgtatcctctaaccaaaagcaagtgtgacattgcaacaaagggaagagaaacaaaaaaccaggctcatgagtattataaagttccagttaggagggaaaagttcaacatggtaactatagttaatttattgtatacttgagaactgctgagagtagattttaagtgttctcaacacacaaaaatgataagtatgggagataatgcaagtataccaagttaatcaggttgaattagacattctacaatgtatacatatttcaaaacatcatgttatgcaccataaatatattcaataatttttatttgtcaattaaaaaaagtcatggccacatacagtggtttgtgcctataatcctgcactttgggaggccaaggcaagaggatcacttgaggccaggagtttgagagcagcctgggcaacatagtgagacctcatctctacaaaaaaataaacacattagcagaacatggtgacatgtgcttatattcctagctactgacaaggctgaggaagtagactgtcttgagcccaagtctaaggctgcagtgagcaatgaacacagccctgcactccagcctggataacagagagagaccttgtctctaaataataataataataatttttaagtaaaataatgtttataaactgtatctatttctgtaataaatcatcagtgtggttattagttttattcctaaagtttacttaaaaaaagcaaaattctggccgggcgtggtggctcatgcctgtaatcaatcccaacaatttgagaggccaaggcgggctgatcacgaggtcaggaggtcgagaccatcctggctaacacggggaaaccccgtctctactaagaatacaaaaaaaattagccgggcgtggtggtgggcgcctgtagtcccagctactcgggaggctgaggcaggagaatggcgtgaacctgagaggcagagcttgcagtgagccgagatcgcgccactgcacctgggtgacagagcgagactccgtcttaaaaaaaaaagcaaaattctgtattattttaaggagttaggaataacaatcttacttatttttatttatgcagtactaaagactattattgaaaaggtaattattaaaattctgattctgattattttcttgaaataacaaattttcctgaaacaatgagaaaaggagagcttttggatttcacttagtgaacaaaggtcaaatatcaaagatatcctggtaggcagtaatgtaagtgaaatatgtatttataagtatatagcctaggacctaattcattttttagatataaatacaaaatgtgttttgtaaaattataatacacattctatttttcagaaactaaactatgtgtattagaaaaaatttttatttagttgtcactggatactcatgaagttattgactattttggagtatcatatcactcatggagatgctgcttatgacatttaagttaccaacgtaatataccttcatcaatttgaatttttagctcttacagcacaaatatgagagagatttgaaatttcttttgatggacttagaaggcacaatgataaggaatatacataaaaaagtactataaagattttcttttgtatctgaatttccagttgtgttcaacttgattatgatactccccatgagggttttattcatgacttctctgcagcctcctgtattatattttcttttttccaagccattattatcatcttctgcctattaaaggatattgtctccacgtcttttcaagtactggaaactgaattttgggataaaaaatgtgttgtctgtgataatttattactttattccatgccatataatagggaattactccagcactgtgtatcagatttcttccttttatcttattagactatctgtaattcatattggtatgttatttctactgaaattaaagataattcctttttttaatatcatagacaaattagtgaggtttgtatttatttaacattgttttaaatctagtatccagctatagacttaatttcttatttcctacactacttgatcacaatgtcttctcctcatcttaattttcttaaatttaaatatttgcatttttgccacataaactctttaaactccttaatccatttttcatgtgtcaccatttttatttcaaaatcttacctggtaaaactatatctctcttgactttcaatgactatttcgtaaaaagaaagtcagtttcaaacagtctatttttaaacaggtattaacagatgtaattcgtccttagtggtgtagatagcttgtaaaattttattttcttggtaattttcagaaggccatacctacccatttgaatctttagtttttcaggagacttgtttttgtctgagcaagtgattaaggacaaccctaaaatagagcaaataaaaatattatcacaatggaattgatttttattggtcactgttcaaagagataattgtattctgttggattaaatctcatattccaaatgtcatttcctatcaaagctaatttctctgctctctttagggcactgtggacactgggcatttccactgtaaataaaggaacagcatgatttcagggagcctttctggtataaagccttttcctttttttcaagagtcagagaaataaaaggtaacccttatcccatgaagaagagcagccacatttaagatgacacaaatgacaaagtatcatctaaagttaaattatctgtttgcttatgaatttttctgtttctgttaatgatagggttagactttgtgtccccacccaaatctcattttgaattacaatcttcacagtccccataattcctacatgtcaagggagagaccaggtggagtaattgaatcatgggagtggtttcccccttgctgttctcgtgatatttcttctcatgatatctgatggttctataaggggctctttcctctttgctcggcacttcttcctgccaccttgtgaagaaggtgcctttcttccccttcaccttccaccatgattgtaagtttccttaggcctcctcagtcatgctgaaatgtgagtcaactaaacctctttcctttataaattacccagtcttgggaagttctttatagcagtgtgaaaatgaactaatacagttaccctcactgtaatttaagctatacatggacaggaaatgagttttgtttcctgttgtattctcagcacctagaattgtgtctggtacataacaggaatccaataaacatgtggttgaatgaaaaattatttaccagattaattagataacattaatgatattgtgtgtgccttctaacctttacaagttgagagagtgtaaaaaacatgcaaaccaaaaacataaggaaatggcaggagcagtaactaatttgaagacttacctttccttatatctgatactaactagctgtatagtaggatataaatggtttctccttaagaattggtttttccatataaaataaaaggattagaataaatcaatattttaaaatataccttgagtatttagtgaaatgtatgaactatttgttcagagggaaagcacatcatacgcacaaaaatatgcaatgattttcaggggtcctatgaccccaggttataaaaacaatatttccttgagctttaatattttaataaatctaggatgcaaaaattatcatcatgttcccccacaattcttagagctgtgaaagacagaataggcataggaactcatgtggaaatttgccaaaagtcaaacagactcattctaaaaaaaatcaattctttccactatgccatgcttctattacatgcacttccacaaacactggatctatatggtatgattagcatgtcagagcaaaaacagaatctatcatggcaatagtatttgcctgtatattctttttcttatttgtattttttaattatgcgcaaaatatagaaacactgtgttagttacctagtggagaaattactcccaagttcagtggcttaaaaaataaacattatcgcatagactctgcaagtcagaaatctggaaatggtttagctaggtcctctgctttgggttcctttacaaggctgcaatcaaggactcagccaggcccacagtcatctcaaggttcacttggggtaggacctgcttccaagctcaccccgtggctgttagcaggatttggttccttcaggactataagcctgagggcctcagttccctgctggctattggacagaagcttccctcagttccttgtcatgtcatcctccctatcacaaccagcatgtgggagaagccagggaggacaccagaaaagcacgatcttttataacctaaccataaaagtgacacttcatcactttgccattaaaagcaagttattctcctcatgatgttcagtgcacactcaagagtgtgaacagtagaaagttgggattattgaaaactatctctaaagctgcccaccacaagtatacttgcattacattgatgttttttaattcaaattttgtaattactctcaagaaaaccttgattgatgaatgcatgtggtatttcagagaatgtgttcatttattccttcaaaaccatttagtatttgccacaccttgtgccagatactcagaagaaactgggtatctcactctttgccgtcacgcagctcagtttctgtgtcaggaaacaaatgtttaacaagtccatgaacaatgctgtaatgagggacatctgtgtgatcagaacctttccatgtcaatgtatcctctttgtggtaacttcgaagtatgtgacttgctattaccccggcattaattacatttttatgcttaaaatttgttttatttgttcaaccaaactacagtcagcgaaatgtatggactatttcttctgagaaaaaaacacattgtatgcacaaaaatatacagtgatcttcaggggtcctatgaacccaggttataaaaacaatatgtccttgagccttaatattttaataaatttaggaatttaataaatacatttaatacatctactccattatagtaaaatggaaaaaggaacacgagaacaaattagtaaaattataacactgtgatacaagtctggcacacacacacacacacacacacacaaggaatggtcacatcctttctcgagatcaataaggaaaggttttcatagggaaggtggagtcaggtttgattcttgaaagttaatatcccagctgtatggctggatgtctgtgtttggtggtacatttagcaaggcaaggaagacattaaaagaagcggatttagatgtagtatgaagtattatcttatattgcattggtcagggtttaattgaagaaaaaaaaaggatccacactagttaaaacaaaacaggatttaataaaggtaattaggttcttgcaaaattcctagaagaagctggctctaagctgaggtacatgaggacaactttagaatggagaaagacaaatgtcctttcctgtgtatctctagaaacgccatgctaccaaatttgcactattttcacatctgtgatggtcgttttaaagaagtctgggaaatacagtctttggttcctttgattctgctaaaagggaattgaaatgtagtagccattctcagcattagtctctctcctctctctctttctctctctgtctttttcatttgtgtcaatttgagaagtacagttttgtggcatagatatattacatagtcatgaagtctggactttagtgtaaccattatccaaataatgtgtactgtacccattaagtaattcttcacattttaattttgaatatgtagtttgcagtgcctgtgggactcccttgtggagatgccccacaagcattggatatgcaggtctaaattccagagacaacagaggagtaagacatctgtgggctgctgaaactctgaaaatatatatcactcggaaagagggtgagaagaaagaataaaggctcctaatacctatttggctactatatgttcattttagaaaaaagccaaaaacattagaaactcaaagttgccaagtaccaattagaaatctgtttcaccttttatgtgatatttgaatttgattgtcaacttctgggcttaactgatgagtaattacattgtactaaatagatcctcaatgtacctagcccattgcagacagctctgtgtgatacttctgttaggtggagtcgaaatcatcctcctcataactttcactctcttttttattcctgcactttggagtttttcagaatatgtttgcgtcaatttccttcaaaggtcaaccagaaattgaagggagttcataagtctctgatttggatcacaagcctttagttcctttgaatgcttggcaaaaatgtttgtgaagagacagagatcttggaggaatctatttccggttgctctgtgggtttccagtgctttgaagggcagtatgaagcctgaccactgccactctttcttccccacctccacctccccataccctcccagggcatctacctccctccgaggtggcggcccaggtgccacctctgctcgcctcagtgggtcagtcatgccacagactggtctgtacattttcttccatgacctttcagaaaaaatcttgccattttctcgcctcatttgtctctcctgaagtgtgtccttccctggacaacatcagagggcttagagaaaatctgatgcctgtaagtgagtggcctcggggccagagatgaatgaaaatacaaagaaatagatctcaggaccccatgttaaggatacgatttttggttttcaaaatatggctaggaagtttcaagcaaacctaagtacctggtgctaacagtaggcacagcaagaaaaggcagctataaaggtctagaaagcagagtgatattaggccacatttcattaaaaggaactgttttgcaaaggcaattctgtagcatggtaaaaccaactatatttttaatctaccatgccctgtaggtactatgctagatccttcacttacgggttttatttaatacttaacaggagaatagtcattattttccctttaatgtaaacaagaaaactaaaactcacataagttacgtaacatgttgtaatagtctgttctcacattgctataaagatactacctgagactggataatttataaagaaagtagatgtaattgactcacagttcaacatggctggggaggcctcaggaaacttacaatcatagtggaaggtgaaggggaagcaggcaccttcttcacaaggtgacagaagagaaagagagagcaggggaaactgccacttttaaaaccatcagacctcctgagaacgccctcattatcacaagaacaacatggtgaaaaccgaccccataatccaatcacctcccaccaggtctcaccctcaatgtgtggggattacaaattgatgtgagatttagatgggaacacagagctaaaccatatcacagttacctgtattaactacttaattctgacagtgttctggatgacatagcatgctgagaggcaaggtgagttgctaggctcagatcctttttggtctgttctattgctcagtggattaatatgaccagggttaagatccaacataaattcttaggatgctttcattttactttattttcttcaggtcagaaaataggtttagcttttccctgtccttgcatctataaatctctacccaaaatgtagagattgtaataagtgccaggtgattaacttgttaagacaattagggtattgtttaggaaatgtgggttgcattctcaattctttggagattggctacctgcttattgatttaaagactattatcatttcaagagatctagagtccagtgaccttgacccagttcctgttagcaatttttaatttgcagatgaaaaacctgagacccagaatgatgaaatgatgaggtgctttgtcaaagtcattgaacaaattagtaaaagaaaataggccagaatttggaactatggaaacttatatccaaacttatccctccacttgaactagagacttttgttcctttctgagaaatggggttaaaacattacccataggtaaacatttgatcacatggccagcagctggtttacactgactattaagcagtgatctctgctctctcttagaaacttgaattcctaaaaggcggttgcaggacttactcatcttcctgtatcatattcttccatcatctttttcctgaatgggatattagaccacttggaaaatttttacaaatgcatattgtatccatgtgtgcaatacaagccctgcttcaaatatgtatgtacattggcaacctcttctgttcctttcaggaagttgaaaacagatgtttcaattaaactagtaactgtgcttctgtatttgtgtctggaattcaaaaaacttccatccagtggattaaagtcacattcatacaatttacctgatgaagtgggagaataacatatttgatatattcagaaatattttgtcattggaaggtatttttcatttacctaaaaaggtatttgaaaagatatgtatgaaccaaggactgaaattccactttgcccaattattatactttaacaaatatctcctgctctaaatcattaggactgctatggactgaatatttgtgtcttctctccagaaattcatatgttgaaaccctcatcacaatgtgaggatattaggaagtggggtctttgggagataattagtccatgaaactgaaatcatcatgaatgggattagtgctcttataagaagatgctagaaagctagctatccctctctatgtcatataagcatacacaggatgggtgtctataaaccagaaatggggtactcaccaggaccctaacaatgctggcaccctgtccttaaccttctagcttccagaactataagaaataaatttgtgttgtttaagacacccagtttatgatatttttagaacagcctgtgctaagacaaggacttattgatatgccatatcatattgcttgctaatgccttccaggtagcctcctttgtctacataggaagatgccaatcttcttatacatcaataaaccatgtttgtttcttgtaatcttcaggaactatcatagtaaataatgtatttttatactgggtgttcaccgaatacctcctttttcatttcagtgagcgtttgttatctattacattccaggctcttagaaagtaaaattaagtaaaaattggttcccgccttcaaagagctcctatttttatgaagggtacatacatggactcggcagtatacaatataataaatgtacattctacagactatcaatgatcgtctctacgtataccagactttatgttagaggttagaaatacaaatattaatagaattcagcctctgcctgggaggcaagaggcactctccaggagtgcccagtttcctgttttctccctctttcagtccagtgagagagacatgatggcccagcttgaaaaagaaattgaggatagcaagtgtaacataccaagcattccacgagcaggtaagttacagcacatattggaattccggcctcctgatttcctctttatggcttgccaaccctcttcgtcagcatttgacatgggaactctgggctaaaagataataggttcatactaggcctggaggggctggaggcttaatgaaggggagggcaggatatagctgtggaaacctgctctgtctttatattctaacgtcctctctttcactcttctgttagtgagaaagagagatctgtaaaaaaatatgtgctgttacccagcttccacaccccaatgagaacagcaacccactcctcccctaggggctcaactcagtccttctgcttattaggtttgtttttacttaaaaaaaaaaaaaagtgtgcctgcagcttgttttcatctcataaagactggttgaacaccatgaaaattggcattcatttttcacctgatgattttattggccactatgttttaatctaacattgacactttgcttgcttctgttctcttctcttgaccttgccttttatttgatctgaaataacccaattaaattagcttggcacttgctgttctgcagtaaagcacaccgaggctttgctggtgatactgggatctgttattcgtttcagttgttcacagttaagcctaagtcctctctgtcttcaaaatgtaagagaggccattccgtcattcattcattcattcattctacagactttcattgatcatctctatttataacacactttatgttggaggttagagatacagattttaatagaattcattccatgcctggaaggagccagaatgaatatggtatagagtgatgagtgcttgaacagaggtgcacagactgtgctatcagggcacagagaaggtagcaagaaaaagcacatggaaaactaggttttatggaagaaaaggaatctgaggtaatgtattgaagaataatgaatcagatgatggtgagaagatggccttttcaggtcaagaatgggatgtgcaaaggcacagatgcatgaacatgtcagtgtattcagagactgatgtggtgtgtggtcacctagaggtgaaggcggcatagggtgagcaaagtgagaagggtctgcttgggaaggtaaggagcaaataaaagaatttgaaagcaggctgagcaggtaggtggacatttaccctgaaggccagtggatccgatgctagagtccatgtgctgatgttaagagttcataagctacccgaaatgtcatatattttgcctacatacgcatattatgtgttgggaagagggagaaaggaagacgacttacaaaactgtgatgaactattcaaagactttttttgccccaaataatttgaagccatttctgtaggaaacaatgcaccattgtagagtgttaagatgatgagaaaatgattaattgaagtgcttgagaaattcttaatatgcaatcaaattatttgcttcctgtgtctttaacgtaaataagtgcaattgttgttttcatagtgtgccgaaaaatacttattgtgatcagtcagaaaaatttgaagatttttgaccagctatacagactccttcttaacttttggcaactttgtttgcttccaaaattggtcatctgggaaattttgaaataggtattatttgaaaacaaagcactctatttgaaagtgcttgctgactcttgcccataggcagcatggcatttcaggcaagggtgtgtcgcaaggtctctgggtctgtgagccatggctctgaataaaacatggagtggctgacgcatgcactggcattagcctcatcttttccatattcatagcttctacacaatttttaaacaaatgcctgtattttcatcatgagcaaaaacgcagtctggaagcccccttgggagcttatgcaagagttttacacaggatttgaaccttgaaccttttctacctctacactgcatgaatgatgtaaattctccacagtttggggaaaatgtgatgcacatcagtaacaattaccattttggtcacaaaataaatgatatatttttctgataaataagtgaagcaaaatatccaacagtcactactctgtgagacttgattcagagagaaagtgatggctatctatatttcaaatgacacatttaatagaaagaacaaaaaaggagaccctatgacctggcaatcttgggatttgacagacgcatttcagagccttagttacaacctagtctagttaaatgaaattgaggtctaggtttcattattggatgttagaagttaaattgcaggtaaataaatatacaaattggaataaaaagggcaatgccccaggcaactgaagttaggcttactaagtgcaagtgctttttttctaagtatgatcttacttaaatcccacaatagccccataaggttttcattatgttttacttccttttaaagattaagaaaaaaaaaaaaaagaagacccagtaagtggctttctcaatttagtcagtgataaacgtggattctgtgtgttagtttggtaatgattattgttatagcaaaatcccccaaattgcaatgacttatcaaaatagaagttaatttctccctcctggagagtccaacatagatgtaccttggtggtcagaaagtcttcaccgtcttaattctgggatttggttctttctaacttgtaactgatccatgcccaagtctatgaagttcctgatttctagccagggcacagggaggtgaggaaggcttacccattttgcaatattacagcgctgaaaactgtcacatcagcttgcttagaagcaggaaggattttacaatattgttccattctgggcaagcacttcccagaaacaactgcatactatagaacagtagttgacagttttggtagacgatttgttgtctctgttaaagtttctgtccctagttcagtttattatatgaagttagtggtattcaatgcaatcagatccaaatccgttttataataaatagttgaatactttctttgttatctggaattataatggataagttatactacctacttatatacaagttttcgaaaagtaagtagaatttttcatgtaacataaaaaaaagtaacaggcagttatgacaaataatagatgttttaagacatgaatactgaaaaataaccaccctaaaagatataatgtattagatatttgtgcataagtatagaatcactgtatatgtgatagcgacaaacacaaactgacttctgttttgtattagatattcaaatttcatttgcactgatgcctttgtttacatgatttttccaatagagcacagcaagtcttagtaaagtttcaagaaaaataatttacaatcttccttcagtacagaacagaagtatcttcatgtattgcatattaaaaccatgaaaacattactttgtacttatatgtaaaatgaggttgggtttttattcctaaataattataagtgggtttttttgtttgtttgttttacctacatgaatgggcaaatggttgagtgcatggggtgtgtttagtagtttcacagttggcaacccaatcctgtctttggcccattaaatttgaataatgtcttaccgattattgtaaacaacagagggatcgtccaaaatttacaaaatgctacccagagaagtcatattgctttcttgagtttatatatatatacacacatacacatatatatacacatacatatatatgtatatatgtgtatatgtatgtgtatatatatatatatagagagagagagagagagagaatcgttttagatttacagaaaaatcatgaaaatagtactaaaagttcccatagacccgcaaccaatttcccccattagtgacatatcctcatatggtacccgagtcacaattttgagctaaaaatggatatataattattcattaagtccaagtttgttcagatttcctgatttttgataacctagaaagttttcagtactcgtcaggttattttgtaaaatgtccttcaattaggatttacctgatattttcctcattattagacttgcattatgtgatttggggaggaagaccatgaaggtaaagtgtccttctcatcatatcgtatgaacgatgcctgctgtcaccatgactgctcactcttgatgttgaccttgctcacttagctgaaatagtgttggtcgagattcctcactaaagtaactctgttttcttttttccatactgtactgttggaaatgaagtcactaagtacaagtccaggcttaaggagcagggagttatgctttaccaccttgagggagaggatcaacataaattatttggggcttttctgcatggaaaatctcgctcttctctgtgttttttaagcttattcaatcatttatttatatgtacttatatgaatatatatccataagtacatactgatatacataaagatttaaaaatgttaaaatataaaagttaaatataaaaaataaattaaaaagaaatacatttgggaatcagagaggagagacaatttggtgtataattcaaactatttaattttgtttttcaaattgagttttggccattgttgctctctcagttagtgttttgttttgttttgttttgttttgtgagatagagtattgccctgtcacccaggctggagtgcagtggtgcaatcttggctcactgcaacctctgcctcccaggctcaagcaattctcctgcctcaggctcccaagtagctgggattgcaggcatgcaccaccatgcccagctgttttttttattatttttatttttagtagagacagggttttgctatattggccagcctgttctcaaacttctggcctcaagtgatccaccagcctcggcctcccacagtgctgggattacgggcttgagccatcacaactggcctcagttgacttttttttttttaatatatatacccacaatattgtgggctcttcttctcccccgtcctttttttttttttctgagaactctcttatttactgatgctacaagatgctccaggcttatcctgtatattttttgactaagtcctggaatcagccatttctccaaggagccatagtttctttcactggagaatcaaatcaaaaacccaaatctgtatgctaggtgtcctcattgctactgagagtcatgacttctaggtcctctttcatgacaattcaaaaacataaatgtgtgtatattcaccccttgtgtatacacacatatctttatttttatatgtaaccatttatatttatctaaacaggagttcttactgatgttggcaactctactccattaccacatagatcagcttaacattctcctcctgcttgtcttaacctctccctgaagcagtgagaaacatggcttgctctgtcttccatccatttacttaattattcaattccagcataaatgtacaatggtgtcagaattgttaacttgtactcctgggggaaacaacttttcaactagaatacatagcttttatacagttattttttgcctttagtcttacagatttctctcaccctcttcagagtggttatttcatacatttaaactacagttgggttattttgtcaaagtttgcattccatccttaaatccttcattttctttttttttttttagttgacatgcactaaagtttgctctctatgctatcatttcaataggtttctacaaatgcattgtgttatttatctactattaccttactgtaaacaatagttcactacctaaaaaaaaaaaaaaaaaagaagttctttgcttcacctatcaacccttgaaaattgtggtggtctttttatagttcctatagttttccttttccataatgtcatatgaatagaatcataaattatgtagtcttttcagattggtgtcttcacttagcaatgtgcatttaagattcctttatgccttcatgtggcttgatagtttattccgttttgtaagttaatagtattctgttgtatagatgaagcatttgtttatctattctcctactgaaggacacctttgttgttttcagtttttgatgattatcaaagaactgctataaaccgtcgtatgtaggttttgtgtgtcagtgtaagtttttcaatcagttgagtaaattcctggaagtgaaattgctttattgtatggtaaaactatgtttagctttagtgcgacaaggacaaactgttttcaaagtggctgtgccatttagccttctcactagcaagggattcattataaaatcataataatagtccacattcagtattctcaattgagatattaatgtacttgggtagagcaattagttttaaatttcaagactgtcttgcacattgcaagaagtttagcattcctgagctcctggtgctaaatgccagtggaccctcaatcactgttacaaccaaaagccccctcaatatcgtttaatgttctcaagcagaggggagatgtaccaccacatgataaactgcattgacctctataaagagtttataataaatttgaaaagcttatgtcataataagaaaaattaaagatacaaaattagctcttcaatgaaaaaaaggtgtccagattatattaaaagctgaaataaaatatattaacatatcaaggaaaatcagctctatatgttggactatgagtaaattggtaccagtagagtcaggtattgctgaaaacatacccaaaaatgtggaagcaactttggaactggctaacaggcagagcttggaacagttttgaaggctcagaagaagataggaaaatgtgtgaaagtttcgaacctcccagagacttgttgaatggctttgacaaaaatgctgatagtgatatgaacaataagatccaggctgaggtggtctcagatggagatgaggaacctattgagaattggaacaaaggtgactcttgttatgttttagccaaaagactgtggcagtttgtccctgccttagagacttgtggaactttgaacttgagagaaatgatttaggatatgtggtggaagaaatttctaagcagcaaagcattcaagaggtgacttgggtgctgttaaaggcattcaattttaaaagggaaacagcataaaagttcagaaattttgcagcctgatgatgcagtagaaaagaaaatcccattatttttgagaggaaattcaagccagctgcagaaatttgcataaatagcaaggagcctaatgttaatcccaagaccatggggaaaaggtctccaggccgtgtcagagaacttcacagcagcccctcccatacaggctcagaggccctggaggaaaaagtgattttgtgagctaggcccagggtccctgtgttgtgtgcagcctagggacatgtaccctgtgtcccagatgctctagccatggctgaaaggggccaatgtagaatttgggctgtggcttcagagggtggacccccaaggcttggcaggttctacatggtgttgagcctgccgatgcacaaaagtcaagaattgagctttgggaacctccgatgcctggatgcccaggcaaaagttttcttcaggggtggggccctcatggagaacctctgctagggcagcgtggaagggaaatacagaatcagagcccccacacagagtccctactggggcattgcctaatggagctgtgagaagttggcccccatcctccagaccccagaatggtagatccactgacagcttgcaccatgtgcctggaaaagccacagacactcaatgccagcctgtgaaagcagcagggagggaggctgtaccctacaaagccacaggggttgagctgcctaagaccatgggaacccatcttttgcatcagcatgacctggatgtgagacctggagtcaaaggagatcattttggagctttaaaacttgactgccccgctggatttcagacatgcatgaggcctgtaacccgtttgttttggccaatttctcccacttggaacaactgtatttacccaatacctgtacccccattgtatctaggaagtaattagcttgtttttgatttacaggctcataggcagaagggatttgccttatctcagatgagactttggactgtggactcttgagttaatgctgaaatgagttaaaactttggggaactgtcagaaaggcatgattggttttgaaatgtgaggacatgagatttggaggggccggggcagaatgatatggtttggctgtgtctccatcaaaatcttgacttgaattgtatcttccagaattccaatgtgttgtgggacctagggggaggtaattgaatcatgggggccaacctttcccgtgttattttcatgatagtgaataagtctcatgagatctgattggtttatctggggtttctgctttgcttcttcctcattttctcttgccgccaccgtgtaagaagtgcctttcatgtcccaccatgattctgaggacccccccagccatatggaactgtaagtctaattaactttctttttcttcctggtttccagtatgtctttatcagcagtgtgaaaacaaattaatacaataactaattttttccttatttactctcttttaatttttattttgtaattagtgtataggaagtactcttttaagagaaaaacaaagaattattcaaaaatgattctatagcaaaataattcagtttattatattgtgtggattgtgaacagctctttctgagaaagggatgttcatatgttttagacattcttccattctttttctgaatcaaggccaatgttctcatatactctgtttgattgaaaatggtgacaggacaaaaacgagagacagggaaaatggcagaaaacaaccagaaggatttttctcccccatgttctgtgtgtgcttccaaatggattctgcaaggataacagatgatctcaactgactgtacctttccttctccaattgttttgaatctccaattgcaatttaaaacaccagagctttctgtttaagatataaattttcttcacattatatttcagaaagggaaaaaatgagtaaagttaacaatataaggcatgttgagaggagaagactctttaaaactattttaacttctcataagacaggtaattttagcataagacattttgcctggcaactgttaccagtggatttgaatgttaagggagatgttgtagaatatcatatcctggctattttccactcactgatgaaaactagttgaagacatttacaagagcaaaatgatgtctgtagggactgctaagaacattttcagctgagcttagggggaaaaacgtacttttgtgccagacagatctaagttacaaacccgtctcaacttctttctagctctatgccctcagacaagtgagtcaatctctctgtgccgcaatttccttatcatacaatgaagattctgactggttattgaaaaaattaaatacgtaagatttctaacacccttgaagacatatttaacatattcatattttccaggacctgaagttaagagaaggaattaatttaagtcagcatcaaaccaatgtttgctgctcttttgctcactggcttttaagaaattgagtattttcttactttaaaagaggaaaataaatcatattgtaatcaccttatacgtttatcagatatctattgctttataactagtcaccctaaaagttagtggctaataacaaaaatccatttattgtttctcatgattctgtgggttggctaaaacattctgctcaacttgcctgggcttaatcatgcgtctgcattgaggtagaatttcagctggggtagaaatgttgaaaacggtctcatttacaggtctggtgattggctctgtctattggctgggtctccttggttctctccaacgtggcctctcatcctccagtagactagactgatcttgtttatatgatggcaaaggcattccaagacacaagtgtacaagccacaaggaattcacacaacatcacttttacccccattctattgccagagtgagtcacaagatagcctggcttccagaggcaaggaaactgatgccatctctttatggaatgagctacaaatatcgcagccacatttttttcagtctaccacaacacatttcaggacttttaataattaattatcacaaatgctttgtgagatgaacattgttattcacattaattaaatattagctagcaaatttagaatgaattatagtgtatggtggttaaaggtaaagattttggaatcaaattgtcttgataagaattcaagctccctctattcccactcttaaacaaattgagtgaactcaggtgagtcacttgatttattagtttcctatttttgttataacaaattactaaaaactgaggtgccagcaggacttagttccttcaggaggctctagcagagattatttttccttgctttttccaacttctagagactgcccacattccttggctcatgttcccacatcgctctgacctctctttcatcattacacacagtcctgactctgaccttcttgcctccctctttataaggactcttgtgattatatttggcccacctggataatctaaaacaagctgcccaactcaattttcttaagttaattgtatctgcaaagtcccttttgctaagtaaagtaacgtattcagaggttcaagggattaggatgtgaacatctttgggtggagcagcccctttttcagcctaaaacacttggacaagtcattctccacggcctcaatgttctcatctggtcatgggagtaataatagctatatcatagctttgttatgaagtttctgtgagttaaatataggtggtatttacaacaatgtctgacactgaggaagctctctataagcaacagctattgctactctcattatcattacagcttcacctggcttactaaatgggaagtaaccatctaaactcatatttggctgcacatgaattctgaataaatcattcatttttaaataattgataatttttatatattttgtcactattcatgcatagtaaacatatcaaactgccaagaaacaagtgtctggttagaaacctggttgaaattgtgcaaatatagaaaaggggctaaaaatgaacttttaataaatatagtccatgcacagtggctcaggcctgtaatctcagcactttgggaggctgaggcaggcagatcacctgaggttgggagtttgagaccagcctgaacaacatggaaaaaccctgtctctactcaaaatacaaaattagtcaggcgtggtggtgcatgcctgtaatcccagctacctgggagactgaggcaggagaatcatgtgaacccaaggggggtggagtttgtggtgagccgagattgtgccattgcactccagcctgggcaacaagagtgaaattccgcctcaaaaaaaagaaaaaaattaaacttaacagaacacatcctgagtgcttaccaggtgaccctgtacagcttactttctcatacattgtcttatttatcgctcccaaagtcctctcttattggtgacttcctcatcaaagtacacattattattttcatcttacaaatgagaaaaacagaactccaaatggttgaggatactcaggtcccaaagcaattcaagtcagtctcacgatgaaaagcctgctctcatcccatccaactggattgtcataaaaggaatttttatcaaacaacttccagcatatattgcagtttacactttcacttgccttgtttgtgtgaagagaagtcataagaatattcttccctcaatttctccaaataaatacgaagggaaaaatctagtgcagtcaggatggcaatcttacaagcatggcccttggtagcccaacctggagacagcccgaagaggcagtcctctaaaagctctgaaaataggtaggcaagtcttaaagtcaaaaaggcactcagtccacgtcaactaattgcattttagaaaagtgagtataaataaaggatttattggtgggcacaaggcaagtggggtatgtggaaacctgtttttaccagcgtgggcagttaccagcctgagtggtcctcacaaacgcagacatcgagcccactaggtcagggtttggatacggtgttgttgcgtacaggattctttagggtttagaggaaagaaaagaaagtgaaaagcaaacccagaggatacttggagagcggctgagactaataaagagtaggaacatctttcatattactttgttatttggaaaatgttatcaaaaaccaaaggacacatgaattcaggaaaaagtgacagctatattaagtttttatataatttaactcatacaatgaagctgagagtttattactcccattttacagatgataaagctgagtctctgggatattacattggtgcaaaagtaattgcggtttttgccattaaaaaaatgacaaaaaaacacaattacttttgcaccaacctaataattaactttgctgagatcacaaagccggtaagtgacagaactagaaacagagtctaggtattcttgctctgaatccaacataattgcagaaacatcaggtgtgtgtttgcctccaaaatgttcaccagtctttcttaccattgtggtatctatagatagagttcaaaggtatgagaaagggtgtttatgaatggcttgttaatggaggtatgagcagagtgaagggaaccgatgaggcacagctacaccctagctccagagcctggcaatagcggggagcagctactgcctgtaggcctggaagggagagaggaggaagcaaaattacagaaccctggagtgctggagccctgagagaagggtgccccacagaatctgagtgttggcagagatgtagctactttcaagccatgggcctgaggcggacaggggttgtgtggataaaccctcagacttctcttttcccttgttcagtgtccctctaggttctctgattggctgaagctactctaagccaagagatcaaagaagctgataatgtagaatgtaagtttgtctcctgggccacaatggaaagcagagactgtagctggaggagtgaatagaggatatgcagctctggtaattctcagtacaattcccagtggtccactctgcagaatgaaccaagttccattttgcccaacttctggcagtccacatttggactgtgagctcacctacagataaatcgtacgtggattgatgcagtaactggatttgtagctgctaaatcttatttaagtgaggacctgtccagtacatgtgaagaccacccatccactgaaagtgataagtgaagctgaatcaatactagactgaatcaatactgagctgaatcaatactttcccaattttgaggaaatcttggaaaatctctgagaaatgtggtagtaattattttgaagaattggaaaactttatagctgattatgctatgtgtggaagatacaacaggattataagagagagaagacaatatccttgctgtgtccagaaggctttagccggggtgtcctactgagagatgacaaacttaaggtttttctcttcccagacattactggacaactagctatgtaattaggtcttatgccgaaaagactgaaaggaaaacatctcagatctaggaatgtgatcaagaaagaaggctggttaaagaataacatggggaaaatgaatgcagtgaaatggttcacgcacaagttctaggaattcagagtgcaacagcagaaatgcgatttttgttagatatttcagaaagtgatgtgagtccctgaggtcatactgcagcgttcaggttctgtttggcctcctgcacgaagctttccttgattggaaaagctgcatactctgaagcacatcgcatgtgtcctgtctgtagttcatttcatttccccagatttgttatcatccaccatcactcatacaagcctaccttcttcatgccaacctttgtaatctttctaccttgctaacctggtcatgtcaaggaccagctaataaatagcaaagttgtaccttgagccaaggtatcttgactcttagtccagtgctctttatatacctctgaagtcttatttgagcttcaaaattatgagtctgtgctctcaagatttttttgaaaatgtacttaatgttgcccctaagcttttatgagaaataataaagttctttccagattg

SEQ ID NO: 13 - DNA, 12649 bp, Homo sapiens
ccagttctcaggcgagagccgcggctgacagggtctgggacagaaggaaagccctccaggtacacgtgcgtcccctcgggccccctgtctgctccccctccgccctcgggcccttcctgggccgccctcctagtggttcggaaagcccaacccctcccccagaaatctggggggaaagctgagaacaggcgcgaagcagtgaaatctggcgagagcagtcgggaggcggggaggaagccggccagcaggcaccgagacaccagagagccgcttccggggccctggcgccccgggaagcccgcggggcagcgccttccacaccgcagttctaggcaagcactaaggccgcggacccgggagaaacgcccagacccccgcctggaacgcagtggagtcctgcgccgcctcgccccattcccctgtcgccgctgaccccagagttgcttgggtttctgctcgaggacccgcgaacacatagtttgaacattttcaaaactagttttaagaaggatcatagcggtcctggcttgcctctccggtctcaggttctgctccattgctcctctcccccacctctccccctctctggatctctccctgtctttccctcgccctcccctttctccccctccacccctcccctcctccccactcctcggcagcccggctccccatacttccttaaatgctcctctaagttcacgatcaaagttaatatcgcccgcaatggttgcgcttttaaaaatttcacagaccgagggagataacgggggaggggggttcacccggcttttccaaagagcccttttccctccctccccaccccttctccatcgtaaaaagtcgagtcgttgggagagagggctttgtaggttataataaaatcctttgaatgcttataaaactccacataaaatcggactgacccaaaacacgaggccgtccccgctccccttgcctccccccttctctcgccctccctctctcgctccctccctcgctgcccgcccgttccccggccgctgctacctactgggggcggctcctttggccggctccttggccacggagtgggctgaaccggacgagctgggatttgtgttctcctcctcagcctccgcctcggcacccgcctcagcccgggacgccagtcccgaggccgggggtgcctcgggctcccccttggcctcgcccttgccggagcaggggggctcggcgggcgggtcgccgccaccgcagtaggcgttgtcgaagaaacggtcgaaggcttgaggcaggacgctgttcttgttgactgaggagtagaagccggcgggggttgcgtgcggggcgctggggtggtggtggccgccgtaggagccttcgtttttcatgaggatctcggtgacggtggaaggaggcaggcactcccggtgcataagctcgtcggccgccgcatagcaggaggagtagctgttccgatggtgccacttgccggatggctccaggccgtaggagacctcccggaccgggggcacttgggccgagtagggataggagatctgacgagagggggcctggggcaggaaggaggagaccgtggagaactcgggcatgtagtaagtgcaactgggcagatagaggttggaggcgcagctccctcgctcgccgaaatctgcgcccctctccttgcgcgacggagagcagaagttgcccaggttgaccgagttaaacatcgttctcctctcctgccggctccggatggaggttttggacccggtctagcgaggggggaaaatttgggaaggcgagatgacgcgttatccgtcttagtctctctctctctgagcacgtgatccaaagtagatattgtcatatatcagttcggagcacttcgcagacgtaggaggggttctctcttaggtaagatcggggacgttcaggcgattggtttgcaaacaccgcagaaacattatgaaaatcaattgcagatttgtattcgtttttctctcgtcactccccttctctccataccacagcacgagcaaaggaggagagagagggttggggtggggtgggcggtgggatgggcgagggtggtggctgggaaggggtaattgtatttttttctagctgctgctcttttttcccccaggattgggggaaggaggagggctctcatgtatgggggtcttgcctcctctctgtgagcagcaccaggagggtgggagtgaggacttctttccccactgcctgatttccccagagaagtgaatcctttcccttaaatctcagggactcttacccttccaacccgcagagacaccgcctgttcacaagagtttgaagaagtccactcttttcctggccagagctgggtgtcaagactacctttctggagtccttagagagactcccggaagagtatctgaagtttcccaaaggtgaggcagcccagctgcaagccagtgtcccaactttgtctggcttgctgtgctgcccctggctagggagtcagattagtcataaacgagtggtgagcagtgcgccagccgcccagccggtgcctggcgaagtctgggaaaaaccttctctaatgttgtgttaaatatttagtatgagagagtggccctgggtgaatatttcatgcctgcctttattgtcaatcaatgtgaagaaagctacatccactgtggattttcaaatcccaaaccccaaagaaaaggattggaatgagagccatgtatcttctatgtcagggccctttggcttagtggctcagcctcagctagtgcgctgaaaagaagcctagtgtaggggtccaggaagaatatggtgggggggactaggtttggggttcttatccttggatgattttgaggactgtaaggtgggtggtggggccaggtatgggtctccagaagagactaaccagacagtggaaaggagcggtggatgctgtggcatcaggggaggcccagcggccactccctagtcaaagcccccagcctctgtccctggggctgtgaccagatcttagtgcctccttcctatttctcagccctgtcctgccctcctacaagtctgtcagcctcctggatagctgtagcccaagaagtaggctcagtcattctgcatccccaaccccttgccttccatccctctgagcaccacaggacacatgtgggcatctgaaaatcactttattgaaaggttctggactgggtccaaggggccaaaagcaaccagcatgagctgaaagcaaccttggatccaaagaggagctgccagggcacaatttgtttgggaaggaggggaagaaccgaagcccccaagggctcagcccaatgcacactcaggggaaaacaaaaaatagcccgaactctctttacatccataaccctcagttaaaattagtttccacttaaagaaattagaatggatttgtcttgatgaaacatgataaggtgctgcggctcccaaaccagataaggaggacacaaaaaattgtagcttgtctccatatgtaacccctaaaatccattcctcctcaatgctcctgcctcctcaaacttgctcagcatttaagtgacacctgagtggagtctgcctccaccatgggtcccattctcagggtggttctggaatactcagggataggtctcaggtgcccctctacgcactcaatgctgggcgctactcctttagttctggtcagatcttaaactgaagcaaagaagaactagattggggctttgctgaagtgtgagacttctgttggtaaggggccatgaaaagaaaaatctgctgtgtttcctttttcctctagccctttttatagagtgagatggggccagcatttttaattatagtggtggggaactatggactatggcttttaatggggttcacactgacctcattaaactcgagtttattgaaggcaaaatgctgcccaaacagtgataggaaccagcaagagggaagcgagaggtacccctatccttgcagaggtgtggatgagggctcgagtctcagatcccgctttctccacttccacccaaggctctgcttccttccccctcctggccctccagggtgatgtggggcccaatcccccaaggcagattcagcaaagccaggactgagatgggggtaggggctgtatcctgtgaggagacagctgctggactgagcacttgaatttgaccaccaaagtttattcctgggccaccataaaagtgagccaggcggcaacaaggagctgctggcggccctatttccttgaaacaaaaaagaaatgcaagaaagaatgtcaaagagttgatgtctaggaaacgctggggtctcccaacagagacttctggaaagtaatattcctccccttaaaagtaaggcataaagtttaaaatgttctctagtgttgatatggcttagtttttcaacaaatcaaaaaacctctagcaactgtcagttgctgctacggtcaaggaaagaaggccctggccactgaggtcagctagacatttactggcaaaaatgcccatggtctggagtagcctccctgcccagccctgggtccaggctacctggacgcttcagctgagatgtttgccctaggctgcaccctctcagcctgtggattctggccacagcatcaatacctccctgtacaggagccatccctggcccccaatcccttccttgtcaagcccgctccaggtggcttatttgtatcttatctggtgggtgcctgtgacccctccatctgctttgagtcctggccttcacctgaaattctctgcagcagggccatccggccctccccactggctcttggtgtcctcagtcagcgccatcagccagcctggctgctagcaggcggctgcggtctgggcagctgtccaggtagctggaccaaagttaaggcagactccagcacccttccctccaacacacggacaacaggggcagcttaagaaggggacagtgtctcctaaattctaccctgggcggctcccagagcaaactcccgcacacagcgttggggcctcctgttagcttgtctacctcctccactgctctgggttctagagagcagatcgtggtagggaaaggagcccatcccacagaccatgaactggggaggaaaatgctgaaagaagaaatggggcccacatatgctccagtgggcttggattgtaaattcagcctgtgtggagtcaataaaaagataagcggagagagtcccacacatggacgctctcgtttgttcacaggctgggccagcaaggagacttcattagaaattggctttcaccttcttgcctatatttctctcccttacagtaatatcactgcctgcaataatccctttagtatgctttgggattttcaggtcagtggtttatcttgcacccgggacaccccagccccagccagggaacaagaagcgggtgggactgctagttcctggcttccacctcttctcagacttggccattgccccaagcctgagtccccaagtcaggccacctaagctggtggacgctgctcagaggttcctgggacctatggaggaggtagtggggagggagaaggacagctcctttgcccccacaggccccacccagcttcctctgtggagagattgtcccaggatgctagcaacccgaccctatttcttcccataaaagccctattttacgagccggtttcactggccccctcaccaaatgctccaaaatgaaggaaatgtcttaaaagcaggctggaaatggagccgctgctattgggcttcagtttcctaagccagttgtagtggcacagaaaataccttttctgggtgggattgccctgttgggccacccagatctcccgcctcaccacagagcagaggcgggttggccggagccctgattctctggctttagctcctacattaaggctcggacctagtcctcctgatcaaagtgagctcgcggcatttttatgagatcaacttcagcaactctttattagcgatcagatgcctgggtcgaaaatgcaaaagggaacaaacagctaatcaatccaaaaggaaaaagaaaagagaggggtgggaaggcatggggtgaaaaacttcaggtgacacaaagcaaaaagattccagtcaccaaaaacaaaaacaaaaaaaaatcttttgcccccagcaagaatcatttgtttgggatctgttccagcctccaggccctgccttctgcctgcacattctgccctgatttccggaacctggaagcctaggcaggcagtggggaactctgactcgcctgtgctctggagcttgatccgaaagcttccacagtgaggactgctccgtggggtgagtgttgtggcctatgcctccttgccccagcaaggaaagtgccttctgctcaggatttacaagtctcccccattttgctgctttcctttcggcgggctcagtggttttctcctcactacagtcagaagttgagttacaggaagattcgccagagatttatcgcctggccccaaacttggagagcctcgttgtcataaacagccatctattgtctagacttttatctccgggtatggatcgtgcattagcgaggctcaggagacatggggctggctctgtggggtgtttgtgcagccggtgcctgcccgcaggccccaggggtttctttgggtcattttatgagagtgcacacatttgtgtacactcttggagctgggcaggtacgcctgagtgttcacgagtggaggcccaaggtagggaagtctctttttctctgtgttggggaacattccggtgcgtgtacttgtgtgttgggtgagaatttgtcatggtatgctttgtttctggggcattttaagtgttcctgcctgggctttttcaggttttattaacttgcatccgcctggcctgtttatatcccttccaagcagatcatctggtgtttttcaatattggagtgcattgtgtgtatttggcttctctcaggaaatggttttgggtgataccttcccaggcttactccctcagatacccccacccaccctgaatcacacctcagcctctgctttcaccaggttgtctggccctgccccactctctgcaagtccctaaatctccaaagtgcctgccaattttatgtcacagacatgaagcacatttttgtagggtgaggtctggctatctctatctttcccacactagggggaagcgtccagctcataaaccacctcactaactggagctccccttcccagactgaggggacataagaaagggcctccccagtccatttcaactgtttaaaatactatccaccgaactctagatactgccaaagagagcctgctgttccctccctggggcttcccggctacccctccagcccgttgagcccaggcattttgtaacataagtggcactttgcccagattaaacgtctatggcagagacacttatcaccttagatcttggggtcagagctgctttgaaagccaggatcatttaacatcaccagaaataatcaaatcctcttcctttgttttttatgatgaaaacacagggtaagagagcaccaggcactgaggcctgggagttccacagaccaacacccctgctcctggcggctcccacccgggacttagaccctcaggtccctaatatcccggaggtgctctcaatcagaaaggtaaagtgggaggtgggggcagatcccagaggccatttttccagttgaggagggtggaggtgacaacaattagaggcttttggagcatcagattgaaccagaattccccatcattgttttctgtgcatccttcccttcccttgccattagaatttcaatttaaaaagcaatgattaggccttaaaatgtctccatgagcccagaggaggcgaaaacgagctgtgaggtccaggaaaaaggtaagtcctccgcagatatccccacaccaattattttcctctccttctttctctctgttcatccccagtgctaccctggaggaaaaggatcaaggatctcagttcgggatccttcctccctgagccttcgagctgagcctgcccactgcccaccgccaaaggctgtcgcggcggatacggggctctttcggtctcgccgggccggctgcggcgctgccttacgctcccggtctccctgtctccctccattcttgcctcacccctcccctagaccagcaaatatccaatatatttgtttctccgcacgccaggcctcagcgcagccagctcagcgctcggggatcgctgcccccgcactgggcccttatgcgctttgcttccagttccaccgactgcagcatctttctttgctagctgcccgggtaaaacgcttctgtcgcactttcctgcttctccccctttctttccgcctctggatctgagaaagaaataaaaccaagcctcctaccgcaccagccctccccacccctgctgcctcacttctccttaccgagtgtaccgccttgttttctgaaggaaaccgtaacattcagacatttaagctgtaaatgaacttttctttatgacgtttaattttctctccaattcttaggtcctgctccgcttcgcagtggaatggaacggatttagaagcctgcagtaggggagtggggagtggagagagggagcccagagttacagacggcggcgagaggtacagaagactgggagatagagaaaaagagaggcgggggaagggagggggaggaaggagggagggaagggtccccagctggcggggagcggagccagagagagaaaaagagagaaaagtttcccggagtcttcattagttgatttccctgtccgccgctttccccggccggctcacccccggtaaaggaaggaggggcgtctttatttttttaaggccccaaagagtctgatgtttacaagaccagaaatgccacggccgcgtcctggcagagaaaaggctgaaatggaggaccggcgccttccttataaggtacgatgctaacttgaccttcactttgtcatggcgcccccgcccacccagactgctgcaggcgcccgggcgagggagagcaacagccgacccttgcttctgcctccctcccgcctctttttatctttcgatccttctctctcgtctttcttattttcatttccctcctgtctttttcttcctcttttttctgtcttttccttttcatttccttccttccttctttttctcctgctgttcttcctgccccctttctttcactcattctttttacccttgccggctggtttcatagcttccctgggttctctcttgccttgttctcaggcacttccttgatctctttctctctcttcccagccttctggtcccttctggtctcaaatcccggaaacaacaacaacacaaatattttcagtccttcctgcatccctaccctgaactggccttcacagccccagcctggcttttgccccacccaggtgttcctgggggagagggggaaggccaatttaggatcaaaagaggcttcactttgggaccagtgcccacttggggatgacaatgaaattggtttggataagaccctgtcttcctcacattggccccacctgcaaagtctctgtgaccctagtggccttggactgagagcaaagcctcaggctgggggggcatggggaaagcagatcccacagctcctgaaactatggggaggggagcagagttcaagtaccaaattgtggttcacccttctctggctttcagcccctaaaatcttagagctttcccttaagacatctgaggaggagatttagagaactagggatttatagagattaaagcatatgtaaaaataggatagagaaagactataagggcctctccaccttgtctattgctgcctcccaggctccagccgagcctctgacattaactctaatcatatcttgtttggctataaaataatattattgatacccctgtaattatctattatccccttacttgtaatgattacaatactagaggaggcaggtctatgctgacaaagtaaagccaagcaaatatcctggaaaatgaaactaaatcaggggcattcaaactcgatctcttgtgcgttcttgagtatgttccaaaatctataagctcctgcctagggcctccttgatttaggaatagccattttgtagggcttagggtgatgttgggagaccctactgtctccttttcctctacatcccatacacccctggcccctcctcctctgcacagacatcagagagggtcagacaataaaagagaaatactttctctctctccctctacaattatccgaataattgcatgaattcttcctggaataccactgtgtagtcagggtcaggatttcagcaggaagtgcaggggacagaattccaaatgggggaagctgagagagtcctgcgttcttacattcccagactttatagttctgtctagtgttacattgtttcttcaggcaaagatctttgttccccttcagtcatatttctcccttccccctccctttctttctctttcccttcccccttttttgagtccctttaaaggagactcagatcatcttctgctcttaatagatgactataaaagtaaaattaattccctcctgccctttaatatcaatatctctccgttaagtatgcacattggcgagagaagtgctgcaacctaaaccagcaattacacccaaggtttgttgttttttttttaactttattttcattgggtctggcttatctgggggtgttcactctggcaagagataaccagggggcatttgtatttttttttcacaagctcgttggggcctaagccagtaccgacctggtagaaaaagcaaccacgaagctagagagagagccagaggagggaagagagcgccagacgaaggtgaaagcgaaccacgcagagaaatgcaggcaagggagcaaggcggcagttcccggaacaaacgtggcagagggcaagacgggcactcacagacagaggtttatgtatttttattttttaaaatctgatttggtgttccatgaggaaaagggaaaatctagggaacgggagtacagagagaataatccgggtcctagctcgccacatgaacgcccagagaacgctggaaaaacctgagcgggtgccggggcagcacccggctcgggtcagccactgccccacaccgggcccaccaagccccgcccctcgcggccaccggggcttccttgctcttcttatcatctccatctttatgatgaggcttgttaacaagaccagagagctggccaagcacctctatctcagccgcgcccgctcagccgagcagcggtcggtggggggactgggaggcgctaattaattgattcctttggactgtaaaatatggcggcgtctacacggaacccatggactcataaacaatatatctgttgggcgtgagtgcactgtctctcaaataatttttccataggcaaatgtcagagggttctggatttttagttgctaaggaaagatccaaatgggaccaattttaggaggcccaaacagagtccgttcagtgtcagaaaatgcttccccaaaggggttgggagtgtgttttgttggaaaaaagcttgggttataggaaagcctttccctgctacttgtgtagacccagcccaatttaagaattacaaggaagcgaaggggttgtgtaggccggaagcctctctgtcccggctggatgcaggggacttgagctgctccggaatttgagaggaacatagaagcaaaggtccagcctttgcttcgtgctgattcctagacttaagattcaaaaacaaatttttaaaagtgaaaccagccctagcctttggaagctcttgaaggttcagcacccacccaggaatccacctgcctgttacacgcctctccaagacacagtggcaccgcttttctaactggcagcacagagcaactctataatatgcttatattaggtctagaagaatgcatcttgagacacatgggtaacctaattatataatgcttgttccatacaggagtgattatgcagtgggaccctgctgcaaacgggactttgcactctaaatatagaccccagcttgggacaaaagttgcagtagaaaaatagacataggagaacacttaaataagtgatgcatgtagacacagaaggggtatttaaaagacagaaataatagaagtacagaagaacagaaaaaaaatcagcagatggagattaccattcccaatgcctgaacttcctcctgctattaagattgctagagaattgtgtcttaaacagttcatgaacccagaagaatgcaatttcaatgtatttagtacacacacagtatgtatataaacacaactcacagaatatattttccatacattgggtaggtatgcactttgtgtatatataataatgtattttccatgcagttttaaaatgtagatatattaatatctggatgcattttctgtgcactggttttatatgccttatggagtatatactcacatgtagctaaatagactcaggactgcacattccttgtgtaggttgtgtgtgtgtggtggttttatgcataaataaagttttacatgtggtgaatata

SEQ ID NO: 14 - DNA, 6467 bp, Homo sapiens
ccgacacccacgggcggagatcacctgctgccccgcagacccctgtcccttcctcccggaccagcagctagaggtaaggggcaggctgggtggggtggactgggagcccagggctaagcagaggaaacactcagcggggagccctgcccagggagacaggcagcagcctgtctcgtcccatctctttggtgatggtctgacctgtgcatcgaaggctgaccacagtctgaattcacagcagcccacaaagcggtgtttcgtccctctgatgggggcttgcagaggggaagtggcttgccggcagtccaggctgcaatgacagcaccgctgcccctaaccattaggcagccttgacccatagaggagccagatgcctgggagagggctcgggccagggatggagtggcgctaatgcaaaggaaactgccaccacctggccatggcgctgccaccacaggccctccccgaggccacacatgcccacctgccacctccacagaggcctatgacctgtcctagatgctcgactcacccacagccacgggacccaacactgcccaggccccggcccatgccacgccctttcctcttacggacaccggctcggtggccgtctgaccagtgagtcgtgaggaaccagcgagtctagactgaagtttgtgtttctaaagggcaacagagagtgaagcggggcccatctcagaccaaactgcaacaatcagtatcagaactcctcaaacgggggacagaaagggagaagaaacctcagcaaacctgaaaccaaccagaaagctgtttaaaatggagtctcagtcccagagagagcgaggggcacgcccttcggcccgggcaggaagtggagggcagtgcccaggctgaggcccccgggctggaggcaggaggcaccacaggcccacctggtgccatgagatatgccacccctgccgtcactcagggccctgagcccagtaacactctgccgtcactgtcctgaaactcttcctttttgagcaaggggctgcacattctcatttcatacatgggcccctaaaatgagggagtggccccagggccaggagggggtgctgagcctgggagacaactccatggcaaactctgagactgagtcacactccccaccctggcggtcttccagggagtgagaccgtttccccggtctcacttccagctccagggccaatgtcccctggtcaagtgacctaagacaagttagcagacactcagccttgactccctaacctgcaacatggggctaaaactggtttgagccagcacaggcaggcccccaccatgccaggcagagtggtcagtcgtacctatgagctgctctctcgtggggccaggtgatgcctgcactgtggggcacagcacaggcctgagggacagcctggggtggagggcacccaccttggccccttcccacccccaggttctaacaagggcccctcactcactgggccccctctcctcttccagtctccagggcctccccgcacacaccttcctcctctcctgccaacctgaaaacagcacacctgtgtgcccctcccatctaccatgggctgtcctctctgcttgcccatgcgtctgccctggagccctgttcctccagtctccgggtcctcacccccagcacatgcaacacgacaccctcaaagtcatgggcccccctcccctgccaccgtcccaccggtacctgctccctgttctcccctgcctcacaggccctgtcaagggctgtgttcctccctccttttacctctcctccacagcccccttcacagccctcagcccttccccagggcttcagccaagcctgtctccctctcccaagcatcactcaccccgccttcttcggccctcagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggtaggggaacctgcctagagaaatagctaaaaggtaatattattaggtagttgccctcccctttgcttgaggacattgatggccaggtgctcgggccagccctcaccctccatgtgagggccacagcagctggccactcgctctcctgaaggaagggtgcggcccacccttccctagggctagggccaccaccatgcctgcttctcctccatatgaggatggctccagcctcctcctcgaggggctgctgtgtccatgaacagtcaccatgccctctctgccccgtgccaccagcatcctgagacagccctgtggaatcagtaagaggagaggggctgggcgcagtgactcatgcctgtaatcccagcactttgggaggccaaggagcactttgggaggccaaggagagaggatcacttgagcccaggagtttgagaccagcctgggcaacatggcaaaaccgtctctaccaaaaaatacaaaaattagccgggtgtggtggtgtgcgcctgtagtcccagctattcaggaggttgaggtgggaggatcacttgagccctggaggttgaggctgcagtgagctgattgcaccactgcactccagcctgggtgacagagggagaccttgaaaaagagaaagaaaaaaagaaaaaagagagggaggggaggggaggggagggggggaggggagggaggggaggggagggaggggaggggaggaaggggagggagggaggaaagaaagaaaaagaaagaaagagaaaagaagaaaggaaggaaggaaggaaaaagaaaagaaaaaaagaaaaaagaaaagaaaaaaggaaaataaagaaaagcaagcaaacaagcaaagcgaagtgagagagagaggaaggtaggaaggaaggaaggaaggaaggaaggaaggaaggaaggaaggaagggcagggagaaatgtgcagagtgaatttgctgcaggcaggaccccggctgttcggtgcagagccaggctcgcccaggatgaggaccctgccagggctgtggcccgtgcctcctcccctcctgctgccacaatgggcacaggcaggatgccagcttctcttatgcaaacctctctccagcctctgcttcagcctggctgtgcagggtggggatggtggatactgggaagccaggtgcccagaggagccccagaagctgtgccatcatcagcacccacctggccgaagcccgctggtgaccccaattcaaaggcaggccaggtgcgctgtcctgccctggttccgggctgcgggctgctctggccccaccgcctgcccacactgccactcgcaggcctgggttggggaggcagagtgtttgggaccctcactctccttcttcaatcttctgagttgactaaaatcaaaacaagagtgggtttctctgctgagggtggggagcaccctatccagacccagggttcaccagacggacatgacttgttacccaggactgtcacagggctctgcacttggccttcaaacgtgggcaagccacgaggcctccaggcctctctggggctgcagatccgtcctcaacagcgctggccagtgtctctgacgctgggtaaaatgggtcttcccctcctggaagagatgctgccccctggtggtggatctactctgggagagaaaatactcccagctggcctgatacccaggcacaggcttctcctaaacacaggtctccccacctgtcaggatgtccaaacggagttggtgggctggatccagaaagcccccaagagagatgctgaaactctcaggtgggtaaaaagagtagacctctgacgtcccagggtacagcccttgctgccatcctgggggcaccctcctaagtgccaggggcaagccatggtcaggggaagcagaaagcggtgacaccccggccactgcacctgtgggcaggtgggtcagggagggtccaggcactcaggatgaacagaactcacctgccaaggcttgggctgaggaggagctggaatcccggagacacactgcccccgcccctcaccacccctgtcactcagacagcacacctcagaggcagaacagaaaacccagagcctcacccaggcaaggctcacgtcccattccccgccatggcactgacccggtcctcccagctctgaggagcctcagatctcctgggtggcaggggtgcagctgcatagcggcgaaattccaagccctggttctgcgtttgccttgtgctgaagttcagaatgcctctgacgtcacgcacaccaaatggacaaggaggtcccctcagcagccccgtgggcggtgctgagcttgaaagtgggaggttctgaaggcattggaggcctgacttctggacttcagagagcgtgaagctgcctagatcgcaagctcattgtgaactgtttgcttgttccctccaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 15 - DNA, 104054 bp, Homo sapiens
aaaagcgcctgggaagagcaatcacaagttgtgacgattccaagttcacagaagcccaagggattttgacatttctccaaggagttagccagaagagatcctcgccggttgagttcagatggaagagaacagtaagaaggaccatcgggctttgctcaaccagggagaggaggatgaactggtgagtcttccctttattttattagtcttctcaaagagcccaaggcggtgagtatgggctacagctgaattagaaaatagagtgtagcatttatgcttcaggctttaggaccttgaaaggtttcagtctggtaaggttccttaagggctgcaaagcaccattttattgtggggaaacctgcaggggctgagaaacttgtgacctctggatgatagaattcttgccatcttcatatgaacctgtgatgtttcctcgcacatttacagtatttgcagagccccgcatggtgctcagtggggtgtctcccccttattatctggattgctatgtgatggaacaaactctattgaaaacaagaactcttttttattctcgtgctttgggtatgtatgcataacctaggcttagggggctctgggctgaagtcatgctttttataagcgcagagagaagttttaagcatcaattactaaagaaggagtagaatgtggcctgggatttttaacacatattttaaacatttctcatgtctccaattttttccccactcttgttttcatcaaacacacacacacacacacacacacatttaaaaataataattaaaaagttgaaaactatagtgtttatttggtgctgaggtgtttatatttatgattttatataatcctcagacctcagtgatgaaagaactaatcctatttaattgaaaagaaatctgagaccagggaggttaaataacttgcccaaggtcattagcctgcaagggacaggctgggaatccagccgactccttctccacatcctgtgctgttcaccatacaacagtggctccagctagacaatgaagaaaggagacagagacagacaggggaagggtcagagtgagggcacatttgggggccccaaagaacttggagaacatggtttgtagattagaatgatgtcagtttcctggctggcatcctggttccctgtgagatctggggcaaatccataccggctctccctccacctatccctgtttgctactctaaggaaaacatatgatttcatctacatctatgttgttcaataaggcagccatgggccacgtgtagtttctgagcactagaaaagtagctagtccacacaaaatatgctttatgtgtaaaatacgcaccagattttgaagaatttagtaaaaaaaagtaaaacatcttattaataatttttatattgtttacacattgaaatgacaatattttagatagcttaggtaaaaatttcacctgcttctctttacatctttaatgtggctgctaggaacgttaatattaagaaggcagctcatatttgtggcttgcattattgtagcacgctaagcttgacaatagcacagcactttaaaatcttcagaattaaagcttttaaagaatgaaaatctattcacctgtgttcactgctgaacaattctgttagctctgatgttttcaacatgtagataagagtgcatgaaaaattacattgctctttattcttctctaactagttgctttatttgtaaagtttatagcctgatactttaattctctcactcacaaacaggacattggtatcataggattaaataatgagccaggtgccccagttttcttcatttttgcaggtgatcaaacccttttacagacactcaccagaaatgtctattaggaatccaagtaagcttaactcattgtggggaaggggagatggctctagatttctttttcagaattctggggcgtagagcacagatgcaaatcctattctggttgatcaggtaatccacagactccgctaggcctgagggagctggggtgaccgaactgtggaagctgtgacttagctccaggcaattgctgaactgatcttgcaattgctagccttttagaaggaagccggatggggaacaacacatactggggcctatcagaaggtgggagatgggagaagggagagcatcaggaagaatagctaatggatgctgggcttaacacctaggtgatgggtcaatctgtgtggcaaaccactatggcacacttttacctaagtatcaaacctgcacatcctgcgcatgtacccctgaacttaaaataaaagttggaaattaaaaaaagaaaagagacccctggccaggcatggtggctcatgcctgtaatcccagcactttgggaggctaaggtgggaagatctcttgaggccagaagttcaagaccagtctggttaacatagcaaaagcctgtttttcttataaataaaagaaaagagaacctagagatctcccttgtcccttctaccatgtgagggcacagagaaaagatggcagtctatgcaccagaaggagggtcctcatcagacactggatctgccagcaccttgatcttggacttcccagactctagaaatagatgtttttaaatctaaaaggtaaaaaataaataaatcgagggaagccagaaatctgactttttatgtgatgtagcctgatgataaattttgaaaacaaattcatcttttgaaaacaatcagtaggtcaaagtaaacctgggcatggtttagtcccagccttgggggctgtcgctctctgatgttgacagcctcgccccacttgctcttccttccccgaagattccctgtggcccggtctaacttctactcgcattcattatttcaagtgaacaatccgttgtgatcgtgagagtcactgtggtaaaaattagagacagtcgaggcaaataatgaactccttcaatcaaacacccatgaagagcctaagtggatggaggggcgatgctgtgagattatgcaagctcagtcttgcgtgattctgctgagctcagcatggagataaagccttgcactggcctctagagctgaaccctgttatcattcccatctcctgttctcatcctggtagtgcttactgtcctgggcatggtgcggtactaggtgcttgacacacaggttttcattttacccaaaactttacaacagccctgcaatcaatattctcactgtacaggtctttattgttttttccaacctactcccatccacttcccaccctcctcactactatctagctctaataggttccttttcttcacctgcctttttcctaaaaatctgccctgcccaggtgtttccctcagcctctccctttgcagtcagtttttcttgtcttctccagaggtctcaggacccatagcttcactaagagcccacaggagccttcaaaacataagacccgaaataaatctgaagcctccaggttatatagctccatacttaatggaatgggatttggcttcaggctgacctgggttgaattctagttctgttaggcaagttatttgacctctctaatacctaccatttgggattgtggtgaggattaaatgaggtaatacagcttttctaaacatatcttctgcagtaggtattatataagaagtttccctgttctccttccctatcaggtttgagaaatactgggtgaaacgggtacacaggtaacagcagggcttctcaaatcttgagtatatttgtcttggtctgctttgtgctgctgtaacagaagaccacagactgggtgattcataaagaaaataaatttatttattattgttctggaggctgggaagttcaaggtcaagggaccacacctggtgagggccttcttgctgtgtcattccatggtggaaggtaaaagggcaagagagcacgagagagcaggagagtaagaggggtcccaacttgcttttataatgagcccactttgcaataactaacccactagggtgaaaacaacattcacaagggcagagacttgtaatctaattacctcttattcgccccacctcccagcgcaagaaccttggagaacacattcaaaccatatctatattatgtttttttgtgatctcttaagggggcattacagtgcactatatagcactatgtatgcgtgtgtgtgtgtgtgtgtgtgtgtgtgtgtgtgtcatggtcttactctgccacacaggctggagtgcagtggtgtgatcatagctcactgcagcctcaatctcccaggcacaagcaatcctcctgcctcagcctcccatatagctgggaccaaaggcatgcgctacaacagctggttaattttttaaaaatttcagtagagacgaggtctccctacgttttccaggctggtctcaaactcctgggctcaagtgatgttcctgcctcgaactcctaaaatgctgggattataggcatgagccacctcacccagccacaatgcaccttatttcccacacttatgcacccatggaatctttcctctctctctctctgtgtgtgtgtgtgtgtgtgtgtgtgcaaatacatgcacagattatctcctgaccactggaacctccataggaaggctggaacgttctcaatgaccgataggtattattttatcattttaccctgctgggaggaaaaataatcatgacggctcttctcagcctggtttgtctggaggcacactgtgtgcatatcagcctctgtttcagcagctcccgtgaccacaggctgcatttgctttctgaagatgactttgattctgaccccactggagccacaagtgctgcttcattcatatcagttgcaaagcccagcaattccatctgtgttccccttctgcacagacacccaccaacaaaatgtcaaaattacacatcacagcagccccagaaggcaaaatggctgcttggtgtggacaaaacagaactgacaaaggtgcattttgcttcgaagtaattttcttctgctgaacagtggcagagccctggactctgagagagcaaacctgggctttagtctaggctcagctgctaatcatgtggttgtggacacctctttggccttgactctttacctaagaacaataccactagctctcctgactcacaagttttgtgagggccacatgcgagatatggaaagggctatgaaaaataagtggttcatttatgtacaagggatcaagagttacaaagtgcaaaaataattagaaaatgcaggaatacatatgttaagtgagattggtgttgaggatatgttctcttttttctggttaagatgtaaagaatgatcattgtttgaggctatcattgagaaaacaagtaatatgtgatgagttgttaaaaaaaaaatcaagaattgcctgggcgcggtggctcacgcctgtaatcccagcactttgagaggccgaggcaggtggatcacctgaggtcaggagtttgagaccaggctggccaacatgacaaaatcccatctctactaaaaataaaagaaaaaaaattagctgggcatggtggcagctgcctgtaatcccagctacttgggaggctaaggcaggagatcgcttgaacctgggaggcagaggttgcagtgagccgagatcacgccattgcagtccagcctgggcaatggagtgagactctatctcaaaaaaataagaaaaagaaaaatcaggaattttaaacatgtagattattttacatatacaatgtaatgtatcttacatacacaaggttgtcctccaataaagaacttcccctcaaaaaaaccactcaaaggattaaaactgaaaagtaaaaattgaaactgaaagtcagccctgttggctctctcctgttttcagtcaacatgtatattatcaggttgaatgaggtaaaggtaagcttatcaatcttcaactgacacctagctataagggaagaacaacaatataggtgacagaatcaagattcaaaaatttgtctaggctggattgtaggtgagaaattggcaagatgcaatgtaacagacctcattattgagtttttgttttaagttattttcaaaaaacaaggtgagggtatcagtgacttgggtttggtagttgtacatgaaaaagtaattgaagtgctttatttgatgtgctgaattttatttgccaatgtgatgtagctataaaaaattagccctggaatgccttagtaaaagcctgttcttcagaatagaagaaataaataaaagttctgccataatctgtatttttttaggaaaaatctaggaagttacatttaattctaaaactcatacttagagagaaatttcaagaagtatagtgtatttggaggaatatctgcatatcgtaagtaagaactgtttaaaagaaattagaaacagtttcccaaagaacagtcataatgtttgtcttccaagagttgagaggctgctgtggagaacaaaagtaggggttggtagattccagccatatttattttccttatggcagaacttcccccttttttttttttttttttttttttgaggtggagtcttgcccaggctggagtgaaatggcacgatctcggctcactgcaacgtctgcctcccaggttcaagcgattttcctgcctcagtctactgagtagttgggactacaggagcacaccaccacacccagctaatttttgtatttctagtagagacagggtttcaccatgttgtccaggctggtctgaatcccctgacctcgtgatctgcctgcctcagcctcccaaagtgctgattacaggtgtgagccaccgcacctgccagaacttcctaatcatctgtggtggcagaaacttaacatgacacccctgtgatcaccgttcctgttgtataatcccctctagctgagtgtgggcagaacctgtaaatatgagaagctaggactcctattattatattatgttctatggaaaaagggactttacaggtataatccacatgaactcaatggagttaataaaaatggagattgggtacacctgacctaatcaggtgactcattaaaagagactgggcctttcctgaagtcagagatagttaaagcacgagagaggtctgatgcaagggaggttctacgttgcatttttgaagatggaagatgccctgtggtaaggagtggttgctaagactgagagtcgcttccagctgactaccagcaagagaatgggggccccccatcttaaggccgcaaggaaccgaattctgccaacaaccatatgagtgtgaagaggtctcttagctccagaaggagcacagctcaggtgacgccttgagtttagtcttgtaagacgctcagcataggacccagctaactgaatacccaacccataaaaactgagacagtaaatctgtgttgtattaagacactgagtttgctatgcagcaacagaaaactaatacaccatcacagctgtccaacaagagagtatgcagccctgtaaggcaacgaaaagcccctcttaagcagacgatagatgctcatctgcaaagaacactgtatagctgttttttcctagagagaaatttgaaccaaataatctctgagactccctccctggttaacaatgctcttattttacaaatgacttttaaccgaacttgccatgttgttccatgcccttgatctagggcaaattctgttttcagaaattgttcttgctacttgggccaggcatctcatcatcttttgacccacacttacagctctctgctgttagcctcaccaaacaaaggtccttagttgcactttcacttgcaggaggactatatgttagcactcttgttatggtagtgccagctgaaattatgggaatacctgtagccaagagtgggatatgttcatctcttttgtattgggtttcgaatcacactgctagatagtgaaaagtttttcttactccagactgaatgatttagtatttattttgaacatacatttccaagactgtttttgttctacaaataatttataaatgttaatacttattttagtaaataataatgcctatttcatagggttgtggtgagaattaaataacacctaataagtactcagaaggattttatcatcaaatacactcaattagttcttattgtcaaatatagataaaagtaaaagggattcaagatatcatatcttattagtttctaacaataaccctagacaatagtgactgttattattctcatctgtggaggaggaaattaaggcatcagaagtaaagtgggttgccaaagtcttatatatggttacgtggtagaggtatgatttgaacttggttttcccatgccatatcctcagcttttaactgctgcaccaaactacttctgatgcattttacaagcagtcacatttttcacacgaaaaatctgaagttcagcaagtttaaatcacagctggtaaatagtggagcaaagggcagaagtgagagcttctagaaggcaacagggtggggtataaagaaaagaggttctggtgtcagacctggaagggaagcctggctctaagttgcgatttatggcaataacctctgtgaaaaagcgcatgcatatttcactgctattcctaatccagactgcttcctttgtattctgggcctagaaaaagactgttagggctgtggtacctctttcagaattctataggaaacaaaaatgtaaaggaacaccactgcttagacagaatacaaatcaagcctgtgtgaagatggacacaatttctgtgctattcaactcaactaacaggtggcagatctgggttcctggcctcatggaacacaggctgtttctattaccggtcttgatccagtatattgcaactaaaagctgaaatagtcacctctttcctcctgtgactgaacctactataaaatcacctgttatcattgactgagctgctttttctctcaacaccttacacctctctttaagccgcattgtttttccaggtgtatgctattaatattcccctaagtacagagatggaaactgagattagagaagttaaatcctcagctcacaggtaataggtggcaaaactcactttactacaaggaaccatgtataacgggtttgagattcagacactttcatcccatttccagtatctttacattaacaccacctctggatactattaattttccttttatggtacaaacatgttcctggctctctcctctaccctgcatttctcagtggattttactgggggcgtgtaaatattcagaaaaaatctgagtgactctgactacatcagaagaataatcatttatacaatctaattttcctctcaattagttggtcaaaataaatacatatactgtgtgacataatttggctgtgtccccacccaaatcttatctcaaattgtcttgaactcctgggctcaaacgatcctcccatcttggcctcccaaagtgctgggattacagcatgagccaccatgcttggcctcttcagagaccttttaatcaactgaaacttttaattttctttacttttaaaattcatttctatatatttttaaaaaacttagagacagtagagacagggtctcactgttgcctgagtggaagtggtgcaattatggctcactaaagccctgaactcctgggctcaagcgatcctcccacctctgcctcctgaggaactgggacaacaggtgtgcaccaccattgctggctaattaaaaaaaaaattgtagagacagcgtatttctatgttgctcaggctggtcttgaactcctggcctcaagcaatcctccagcctcagcttcccaaagcactgggattacaggtgtgagacactgtgcccagccagaagcttttaattttaacaaagtcaagtacatttgttttgtctttctttttattttctgtttaagaaacatttgcctacttgaggttcatagaataattcatcctatggtttctttcagatgatttattgtttcagttgtcacatttacatatttgtgccatctcaaatgaatttttgtatatggtacaaaccagtggggtggggcggtggggggattgtactcatttattttccagtgctattcgttttgctctggcactgtttgttgagcaaatcaccctttcccacacagattgcagtggctcctttcttgcaagtgaagaaatcatatgtttgagtctctttttggactttgttttgttgctctgtttgtttatacttgtgtgtatacctcattttcttaattactgtggctttgtggtaagccttcacttctggtggcataattcttccacatttattcgtttcaaaaattgtcttgactatcctacatcctttgcatttccattccaattttagaaccaagttgtcaattaccacacacacacacacacacacacacacacaagtctgaagagattttaaattggattactaatggctaatccccaaacttaatacagctcttcgtttatttaggtctttactttctcttggcgatgatatgtacttttcagtttagatgtcttgtacaactttgttagaattattacaaggtaatcaatttctttctttgaaggtattataaatggtatttaattaattttcaaattgtttgttactaatatatacaaacacaattggttttcctatattgacctggtatccagcaatctgaataaattcacttattaactcttatactttgtatattcttttggatatttttccacattatctacacatagagtttagttcttgttttcaattgttattcccctcccttcccctcccctcccctccccttccctttccttcccttccctctttctttctctatttcttgcgttgcactggttaagacttctagtactgtactgataaatattagtagtgattgttgacaatctcattttggttgtaacttaagtgggaaaatattcactatttcatcattacacatgatgttgcttaaagatgttctcatctatttttaacttgttgagaattttttaaatcatgtattggtgtagaattgtataagtctttttctctatctattgagatggccttctgagtttccttctgaatattgaagtgcatggaatggcaaagtacattgactgatttttaaatccttgcatttctaggacaaacattatttggtagtgatgtactaaacttttaatatatcattgatttagttagataatctattttagaattattttatctatgttcatgacagggcttagcctgcaattttccttgcttgcaacatatttatcagagtttggtgtctgagtatgctggcttcataaaacaaattgggagaattttcatctcttctacttataaagaggtttgtaaaagaatagtatcatttctatcttaaatatttcaaaggaatcacaagttctctgggcttgacgatttctttgcagggagcttttaaattgcatattaattttctgtaataaacacaaaatattcgtatttattgatgagtttatcaatgttattaatcttttcagggtaccaatttgactttgctgtttctctctattgtgttgtatttctactttctgtcttatttctgcactcatctttataatcttttccttacttttttggggtttaatttgcttttgtttctataacttcttgaattggaagcttagtttattgatttcaaaactttttctctttactaagatttgcagctaaagctgtaaatgtctatgtaaggattatcttcattgcattccatgaatgtttatttctcaattttcattttcattcagttcgaatgatttcctaatatttattgtaattttttatttgacttacctgtgttatttcaaaatatgttgtttactttccaaatatttgggaatttttaagttattctgtttttaatttctagtttaattgtaatgtcatcatactttatgtctcagaatgtgctcagtttaggtaagtattctatgtgtacttgaaaactatttgaattctgcagttgttggctgtaattttctgtatttgtcaattagatcaatgtagctagtggaggtgttcagacttcctgcattcctactgagtgttttgtctgcttattctgctggttattgagaggggggatgtgctaaaatctccaatgatgagagtagatttaaattctatcaatttttctttataatttttaaaactatgttttttagatgtgcaaaaatttgggattgttatgtcctcctgttgaattgatcttttagcttatgaaatatccttcctttgctctcatagtattttttccttaactatccttaaagaaatataatttgtgtgatagtaatacagcgatatcagctttcttccactgtttgcccagtatactttccccttcttttcctttttaacctatccacttctttatgtttaaagtgtgtctcttgtaaatagtatacgataggtcttttattatctagtctaataatctttgcttttaatcatagcattaaggccacatgcatttaatgcaattactaatatagttgggttaaatttcataatgttgcttcttgtttcccatttattctacttgttctttgttcttttctccatttaacattgtatcacagtatgctccaggtttctacatcacagtatgctccattcacaacttactgaaccattagctatcatttggtttttccagtgtttttgctattacagataatgctgcactgaacgttgtatatgcaaaactttctcatttagatattatttcattagggcatattttcaaatgaagaattactgattcaaagagtagaaatatctttacaattcttgatacaatttgccaccttacttttcctaaaaaattattccagttcacaaggctattagcactatatagctgtagtgctttcattgcagtcttactagcattgtgagtttgttttttaatttaaaaacattgtatagaagagaactgaaggggtaccagaattatgattttcattgccattactgtatacaaataaacagaaaaagagaaagttatttatgaatgagctcatttcatgtacaagctagactaaaattccaaattgtcctgcttctatttttgcacacattttgactttggcagtaagcttctgtaaataactcggtaaaagaatgtatatttatgacataatatataaagtggcatatacattttacttggtcctaataaaactataattcacaaataaaactaaagcaggtttatagaatcagagggaacagaaagagaaagaggagaaccaatagaaaacatgcttaaaagcagggtgaatgcatatttctaacttaaaccttatttgaataatctcaaaatagagtggctgcctcattgaacttaatgaacttttttctcaggtggatgatagtgttgagggtcaatggaaaaaatcttaagccaagagatgttttatagcatgatctaaactggcataaaatgcaggatgttcccgcatcaaaagtgctctagacacttagtaaaaactaagtttctaaacatgatagtcctgtgatctggacctgaaaattcagagttcagtcatatttttaaaaagcacaaaaacaacaatagcagaacctaaaataatagtatagtagagatattattcataatcagcatccctcaggggcttcaaaatgcactgaaaatttagcttttcaaatttaaaaaacaatgctatgaaacatcactgtacaagttgggaactaggaattggccttcaataagcaaatctattgtttggcaatttttccttctagaatcaaatctcaaatctttattcagtttatgacaaatattgactaacctactagtgagagtccaaatattttagcatattactatcagggtaaataaatataagctgctttttgaaagtctttcatatccacgagtaattccttaatttacatcaacatactgttttagaaaatagtacatttattcatactttccgtcgtcctcaatcatgttattataagacaaagctgaatggataaagctagatgtatgagtgtagatcacatctgtcatgattttatcatcttcctacaataaattcatattgtaggaattttaaaatattaggtattttaaacataacaatgtttaaaataactaatgcctaaagaaaataaatctgcctcaaaacatgaagtattttataaaaatctgaggtgactcttatgaatatatagaagcaaataaatctgccctttccatactctttctgtttaatgttttagttccatataccagggtagtaaaataagtccttcttttttgatttgatcagtggacagctgcaagcagtcaacttgatttaaccacctataaccagatttgtctcccagccaacattctttcatctcaagtttggtttattgaaagaaaataatatgtttatgtgaagaaaagaaaaatagagcgatcttttaaatttattctccaggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagtgcgtgcctttctgttttctattttgaaagccatgatcgtgtcttctgtattgcctctgtggcataactctgtggctggtattatatttcagaaggtagatttcctctatttaaagagtttccatagatcaaaacaggagaaaatacggcaaaattacctctgcaatccatttgctatctctcattttgacccaggaaggaagagcatttcttctgcttcagcttggggaaatttcgaccccatcaggttaacagggagtgctcttagccattacatgagcagtggctgtcagtgttacagcgtttagagaccataacatgggaatggtcattcagtttttcaaaaatatgtattttggaggatattacacattttaagcacctagatgtcactttaatatagctagaaactattttctggatagaaagctttcctgaaaagtattatctttctttttattttctagcacagtggttatcaaatttcagtgcatatcagaatcatctggagggctcattgaaacaaggatgctggccccacccagagtttttaattcagtaggtctgaagtggggctgagaatttgcatttctactaagttctgagataaagctgatgcgcttgtttgggtcaaagttttgtaccacttggtaggtatttggttgattgagcaccttactgaataacacttgagaatttcatgaactggattgtcttttccaggacgaatttcaaagatatatgaggaagaaggtattctgcctctacttatccacactgaagtttcctgtaagcaagaagtgggaagaatccctggtggctgaccgccactctgtcataaaccaagccttaataaagccagaattaaaagtaagttacttgaagggtatggtgttatgcatgtttacagagaaagcataaaataactgtttattaaatgaaagttccgaatatcacacttttggaatgggaatgacagctatgtatcaaagaaagtgagactggctgggcatggtcgttcacgtctgtaatcccggcacttttgggaggccaatgtgggcggatcccttgagcccaggagtttgagaccagcctgggaaacatggcaaaacctcatctctattaaaaaaataaaaacaaaaaatgagctgagtgtggtggtgcttgcctgtagtcccagctactcaggaggttgaggcaggaggatcgattgaacctgggaggtcaaggctacagtgagtggtcatcacgccactgcactccagcctgggtgacagagtgagaccctgtctgaaagaaagaaagaaagaaagaaagaaagaaagaaagaaagaaagaaagaaagaaagaaagaaggaaagcaagtgagacccacaaggggatctgcatcctgcattggacaccactccctctcccagtgagctttatgctgtgaatgacacctgctctatcacatttgcaatcgtagctgcggtgcatggaagtgcagaaaatcaggtatgtttggaacgacctggagaagcggtttcagaaagttgggtaagtacaatgttttgtcaccccttggtcaggatataggggaaaaacactgatttgttgagtgctatgaactgaagtgtggttcctatcctgaatacatcctaggttgctagaagacagcaattcctgctctgacatccatcagacatttggattgggtctgaccagtgaagagcaagaggtcaggtaggacttattatatgccttaagagtaaactctgccagcagaaaatgaagtatcaaatcagttatcatcagtgcattgttggcataatgcttcatcagcttgttatagtccaagttcatttactggcagcggagatatcctaaattgttcttttcttaggcaaacttatttttacaaagaccaaaagaacaatgcaatcatataaaatttgatcttttatctcaggcttgtagagcaatcatctttgtgttgtttttttatttttcctttcttaaaaaaatcttgagtcattccctaaatgtcagcttagtaatcttccaaatcctgggagagacagaatgacaatactttgattgcattttattctgaagaaacagccctggagatgaggattttgcttgctcggttagttgtgttattcaccactatatctgcagtacctagaacagtgcctgattctttggtaggagctcaatacataattctagagtaaatgagtaagttaatatattcattgatttgttaaataacaaataggtactttgcaaggaactaaggatctaaagacaaaggtttagtcattgtcccagagacacggactagtcagaaagagaggcataaatggtggcacaatcatgagattggtacctatagatgcacataaattaggaaatgcttatgctattattaactcacagagatacagagtccctgctttcttcagctattatttgaaatgatgaaccctggcaaatctgaaaggaaatcattacaagtcttccccagaatcttataatcacctttatttctcacccatttttagagagagtgtctgcttaacctttacagtcggccagaaacacctattctcaagctaagaagtaatcagatactttaaaatataggttttaagctccaccctcataattctgataattctgtaggagcaaggggtacttagaagatacccatttttagcaagcaacccccataattctcacacacaccaagtctaagagttactgatctgttgtttataagtttttcctctatcagacactgtgaaaaatgaaccagacatctggactaggacaatattgcaaaatgccttagaaatggtattattatgtaagatttcagatgtaatgctcaaaacattgtcacaaaaaagtttttagagttattaaaatatattggtttaatagcactaaatacaaggcatgtaaaggatttatctaggacatttaagaattctagttgatagatgtagacacactctgcctaggtaaccacttccacaggaaagatttcctgtcagtgcagctacctcatgtttttttcttatttatcaagcaccaaacttcagtaaacattgtacataatcaaatttaaatctgatccatgactgggcgcagtggctcacacctgtaatcccagcactttgggaggccaaggcgggtggttcacctgaggtcaagagttcaagaccagcctggccaacatggtgaaactccgtctttactaaaaatacaaaagttagccaggcgtggtggcctgtacctgtagtcccagctactcaggaggctgaggcaggagaattgcttggacccgggaggcggaggttgcagagagctgagatcatgccactgtactttagcctgggcaacagagtgagactccgtcacaaaaaaaaatctgatccacacaatatagaacttgacaatctaataagcaagacaaagagtatcattttccaaatatgaagaatggagcagataatctacttataaacatggtcatatttatgttatttggggagtgaaaagagaataagtagaatatggaagattttttcatttcattttttagggtaagaccaaggcctttaaaaaactaagtgtgatggatggttgagtaatatcttaccaatttcctagtgaatttgagcttgctttcattaaaaagcaagtgcataagatgagaaatgaacggggatacacaagaatctctgatgatgaaaagctatagagtttacatgcaaactttttctatgggctccctagcagctgggtagagagagaaaatgcagatttacatagttctcacttttcagtagcgaaagcatatccaaacatcaggagaaataactttaccccggagagaaattgtgagaagggatcagaaagagagcaagtaaattgtcccaggagttccatgttccttagcttcacccgtcatgaactgaactcaaacttccatattagtgcctgtcctaggcaggtcaaaagacattcaaggtaattcttttatatcacaaaagtgagcccataagggaaaaataaaaataaaaaacctacctgattcctcaactagtcaagtagtcttcctattaagattatttatcagttgagcatctcttcaccttatttttcactcagcccacccaccctgcttctgtcccttttgtttaggctgcagaaaataaaaggagtaaatgacttcctggcagcagaaatggaaggaccctctcccagcccccctgcaccaccaccaccaccaccacacacacacacacatgcacacacacacacttgaggttaagtccagaccaatcaccttgctggtgacctagctctcaggaagaaaaaaagctttgatagacagggtttgctggtttctatggtaggaatattccatccatggccaacttaagccaccaaggtgacatcactgaatgcaaagctgggaagagaggctccccgttgatttagtgattctgcaaggccaaatttaattctcaatgtttaccacagcattgagagaaaaggcatgcttgtcagcaccagaggaaaggaatccgagtgacagacagcaagagaaggtaggtttgccattaatgcatagctccaagctgacagaaactgttccatgagaacacagaacatcagaaaagagagaaagaagaagcaaaaagaaggtgagagagagagagagaaggacagagagaggctgctgtgagaccctactctcttactcctcagtcttggggaaaggaaaatttagaaaccatgcttatataccgtgacctctatcccctttgaaaccacctctagaaaagagccctgtagtagatactcagccatcagatcagcatttacagaaggatcaaggaagggctggttggaggagaggaaaggggctttgctcattcttctggaagccaataacgtagtctcaactattagaattcaattagaagttaacaagttacttaaaaatgtaacatatatatatatatcctttctttaaaatttaatgcataagctatttaataaaaattaaatgaactgagatcattttcttttttaataaagtggaattatcagatccacggttctatggatcttggcccatttaaagtataaaaccacttaactctactgccttatttagagcaaagccctacagagggaccaggaaagctaagtccagaatctccctggcaggatcctgcactcggtttctttgtaccccatctccattcctgatgtcctcctggtccattcccttctgcatccctatgcctgggaatgctcaaggcctttccccagaaaagctgactggaagcgcctcacttagctcacatggagggcttgaagtcctctaagagcccaacttctcgagttttcctgaggctatctgaaaacatgcaatttaggcaatgaaagaaatgggcaggtcacacatgaggacaaatgtaaaaaactaaaataactttcatgtcatttgtagaatggagatacattctctgtgtaagtgtttcattaaagtacacaagcaggttcaagctgtaatgaaatagagatgttttccttccataaagcaatttctcaaaatataccaatcttgtttttattattgtttttaatggaagggctcgaaggccagcactcttgttgtgctatacaaccacatccaaatcccagaagttggatgccatgtcctgtgcatctgtgaatatcttaggtcttcctccctttataaaacaagagtgttagggaagtcaggaacttgctaacagaatcacatgggaactttctcaacctctacatgtctgcttcctaaaaattcctaagttcctggaagtgggttatgccagaatctcctggcttgacattgtatgtatggaaaactatagacgtccctgcctgccagagactctgttggaaacttatcagaatggaagcagtgagcaaaaaataggtgtagtttgaaaaactccaccataattctaacatgcccttccttcctccttgaggactccttcagtctttaccacctggagcctaaaatggctaccacacgacacattattaacaattattggtaagttaattgaatgaatgaatgaatgaataacaaatgaaaagggacatggacctcctccaagagaaagtcctcctagtcatctgcattttgttttctcagaaataaataaattctaacagatttactgatatctcagggttggaggaaacctcaatgattccccaagtttagcccatggtccctgcagaaatcccctccacaggtttcctgctgagaaattgttcaacttctggagagggaccatctacctccaaagcaactcttcttctaatgcatagttggaactattaggcaggtctgcttaattttatttagcctacgttgttctgtgaagctgctggaacaatctggggcctgttttccctgccagctggtcagaatgtcagctcccttgtttcttagacctttcctcatgtgaaccagcttcaaatcttatatttcttcccattgctcagccattagtcaacacccctgaatattctgcttggcttgtgctgaaactgagatgggtacatgatctctaaacacacaatattttttggcaagaagcagtagaagagacacagcagcaaggggcatgccaggctgtgatttcaatacagttcagatgaaccgtaaagaggatgatctacaggcaaatattgatcaactggatccccgtcctcatgggatctcttctctcttaatggtaatattgccaaacttggagagccaaagagcatgagactctaggcttgctttctaaactgctttccataccccatgtactgccttgaacctcattaattcattctactatttagggaatatcctctaggtcagacactgcgcccctagtgctagatttttagacaggatttaaaaatctctgtttctgggctgggcatggtggctcatgcctgtaatcccagcattttgggaagccgagtcaggtggatcacgaggtcaggggtttgagaccagcctggccaacatggtgaaaccccgtgtctactaaaaatacaaaaattagccaggtgtggtagtgtgggcctgtaatcccagctactcaggaggctgaggcaggagaatcgcttgaaactgggaggcggaagttgaagtgagcctagactgtgccaatgcactccagcctgggcgacagagcaagacactccgtctcaaaaaagaaaaagaaaaaaaaatctgtttctgcctttaaagggactctaggaaactagagggaaaagacatttaagtatacattatactttaatgatgtaagtgctgttgctaagaaaagaaaggttgttggaagggagaaaaatagagttaattgtgccagagggagtaagacttcaaagatagctgccatttattgagaactaaatgctttatgtatttttctcatatgctactggtagcattttttttttaaattagagtctccctttgttgcccaggctggtctcaaactcctgaggtcaagcagtcctcctgcctcagcctcccaagtagctgggactacaggtgtgtgccacacacccagcttgatagcaattttattaggtatgttttataaaaccccttttacagatgagaagagtgaggctgacccctcattcagccatcaattcgttcattcagcatataataggctctgttttaggcattcggaatgtatcgatgtcctctggaagcttacattatagtggaagatacagtcttttttttttttgcaaacttattaaaatgtgaaacataacgtgtactttcaggtaattatatgcactataatgaaaaatatggcaggataaggagatgaagagaatctgaattaagagtcagggtagctatttcaaggagcattgttagggaaagcccagtaaggaggtgctacttgaacagagaaagaatgaaattcattcacaaagggaacgcccttgtttcattgagggactgagcgggtagacatacgaagttgtggaggaaattagttccagttggagggaacagcaagcacaaggtcttagctgtgttcaaatccaggcctctctgctcccacatttctcaaccattaagcttgattgtcggatctggctctccgaggctgagtaggcatttacaaactgaagaatgtgggaagggcattcaaagcggagagagggagagagaatggaggaccgagtttggggtcctaagttctgacactttgcttaacaacagattattgccccagattgtgtaaaagagtcctgagtactgaaatggtttgagttatgggctctttccagcgggaggtttagggacttaagaagtcaaagagcgtgatgggctgtttgccctctctgattcccaacatccttgaacctcagtgttttcatggcatggagtcagaagacctcggtttgagtcctctctgttctttgcaaactacaattatacttggaaagaaatatggctaagaagtcagataaacttgggctcagctctctgttatacctcagtgagaccaaagatctctcatgcagattctccccattggtcctttctgaggcagatttgtgaagtggagtcatagacaatgctacaaagcctgcctctttctagctttgcgatcctggaaaagtttcttggtttatcggagcttgagtttctattacaataagtgctaataatatgaaatctcatgggaataatgtgatgattgaaggagttaatgcatataaaaaggctaagtgcagtttctgacactgtcaactctgtttaaaagttacattgtaggccgggcgtgctggctcacgcttgtaatctcagcactttgggaggctgaggcgggtggatcacctgaggtcaggggttcgagacgagcctgaccaagatggagaaaccccgtctgtactaaaaatacaaaattagcctggcatgatggtgcatgcctgtaatcccagctactcgggaggcagaggcaggagaatcgcttgaacctgggaggcggaggttgcggtgaaccgagatcgtgccattgcattccagcctgggcaacaagagtgaaactccatctcaaaaaaaaagttacattgttgtgattcatactagatgtgtgcaattttggctacatgccgcactgaataatttcttccattggcaaaatagaggtattagccctttcctttggactattgtgaggatcaaatgaatctttgtaaaaactttgttaatggtaaaatagtatagaaatatgcattcttgttgtaatgcacatatgtattacaccttgtgtataatatacacgtttaccaagtgttagccatgaaggccatatcttccagttcatttgctcgttcattcagttcatatactaatatgtattcattcggttcgtatactaagggccctgtcctaggtgctggaggtaccaaagtaagatagatatgacttctagcatcaagggcaatctagaatgcctgacaagtctaggaacatctgcatagctgtgtctttttcgttgcttttagtatataataaaattattttaaaagtaactcaaaatgaaagtgtctttccaactttttttttgagttgtactacatttaagatatatttgtatcgaggactacagctctgtccatcatacactgactttcatttcaaaaatagtagtttagaattacgtttcaaaagaacttgcacattattttttaatcaaagtcacaaaatctccaaagagtagaaaaatgacttctgtttagtttggcctgtagtcacttatcatgtgcttgtagctatgacactaatggatgatcaatttcccgcagaagattagtgtgtgggcccaacgccattgaggttgaaatccaacccatatggaagctgcttgttaaacaggtaactgttttcttttcttttttttttgaaaaaatagatttctgccccttacttcttacttcctagaaggaacacataaatactttgatgtgaatgatatcttgtttcatgcgacttctttttgttactgcttattttaaactcaggtttactttaaaattcctttccagtgtgagacagattcctgcctcataatctcctgtttgttttgttttgttctctttagtttggatggtggttttggtggtggtggtggtggtggggtggttagtccactgggttgctataacaaaatgtcatgcattgggtggcttaaacaacaaacacttattttcccacagttttagaggctgggaagtccaagatcaaggtgcttgcatattcagttcccggtgaggacccatttctgggcgtgcagactactgtgttctttatgtcttcacatggtggagagagaggtctggtctcttcctcttcctacaaggacactaatcccatcgtgggatctctaccttcatgacctcatctaaacctaattgcctcccaagggacccatctccaaataccatcacactgggggttagggcttcaacctatgaatttagaggggacacaaatgttcagtccacagcatggggcaatgttattatttctataattattgaggatttgaaatgtattcttttggtctttttcaaatggctttattattttcattttcttgagagtaacttctccctttgttagtgttttatttttgtttttgtttttaaaaatattttccttgtgtgcttggatttttttttttaatgcttaccttaagtgggacactttccccatcaatttttctctttctctctgtgctttctgtgcttctttgatggctttgtttgcctccagttggcccctatgtggtccctgaaggtttgggtgcttgtccttcagggatttgtcacatgcatgcccttagccagcttgaggcttagcccagttcacagttgtcccatggacactcctctcccattccacccttgggtggaaagccttcattggttatgactttgctcaacctctattctggaacaggaagcccatggccacccttgttttccaccatatgcctcatttctatcctcagccacctaagggacacgttctgtctctattcctccgagaaaggggctcctagattttgctgtctagtccttgtctggaacccatgaatctgatgatgtgagcccccactcaatggtgcatgtttccagtctatttctaacccataaagatggtcattttgttttggaacatggacatatctttttaatattaaaaaattatttaccattattctgtgtctgaagcagaaaacaggttgctttttttaactttattttttagactagttttcggttcatagcaaaattgggtggaacatacaaagatttcccatatacgtcctgcctccacatatgcatagcttccctaactatcaaaaagtaggcagctttttaaacgtcaagtacgttttcaaattgccaaatattctccaggggtcaatgtgttctaatttgaaaggagtgctagtattttctggcacctatttactagccctttagtagaaagaaaaaaaaaaccaagtacaactatttctctacatttggtttcaaaagaatattaaataagagaactgaattaattagaatagtgttgtttcttctgcaaaaagtatttaaccagtattctactggatttgtttaacttcaagatcatattatcatttgcacataatctacaatcagagcattttataataagcaaacaaaaaagctataatttgcaagtaaagcagttgggattgaaataataagaaacattaaggaacaaaatcttttttaatggacaaaatatatccaacacttaagatacaacgtactaacttatttaccacatgtcagttcacttttaagactaaattagaattgtatttagtacataagggaattatagaaaacagaggtaagagagaatagcactggttttaaccaatatttcatccaattcataatgattagaaagaacactttctcagaaaaataatccttgctttgctctgatgggctctttagttcactttctgcatgtatatcctatgacttttctctggcttctcaggtttgccctctctgctctcattattagcatgagttagcaggacccaaatgggaaaaattgagggaacaaaaaaagttgaaggtattctcatgcgaccagaaatgtacatgtatgagtgaccagctttcaggttggtaataccttctgctttctgctcatgatttgctctgcagccttggggaagacatttctctccagtcttcctccttgttcaagagaagaacttggctgactcttatgtgaccttgctaggacctgtgacatgaaagatatgctatttttaaatgacctgaataaaaaagtagaatctttcattttcattgcgcaacttgactaaatctgcagcatgtgattatatgaaaaataaaactgcaattaaactgttccaaatggaagtacgtttttaaaagagactgaatcatgtacctcccccattatgagtcagtctgtttaagaaggtgaattgttaaattttgttattggtaaaatatttttgaaattcaaaatgaataagaatgatcaacttgtgggcatggctctgaatgcataaaataattttgcttccaccatatcacattctatgtgtttgacattttctcaacccaaatcaatagagatctaagtgaattcttaaatattagaggtttgtgtatgttgtaaaaaaatgagaaaaaaattgataatgaaatgacatcttcttgattgctactaaggttcatgcaagtgacccaaatgccatttttgtgcctgcaggttttaaatccattctatgtgttccaagccttcaccctaactttgtggctgtctcaaggttacatagaatactctgtggccatcatcattttgactgttatctccattgtcttaagtgtgtatgatttgcgacaggtaagacctgaaatcacagccagattctatttagcttctagctaaagaagtaaagcccatggtatttccactgagagccaggagttgctttgtcaaccataagtcataaaacaaaaagtgagggcttaccaaatatgggatgacagaaggactttggactaccagggagagttaaatgtctttgcaaactctgattatcatctgaagccttcatcgaatgctttgtttagaagcactctgaggctctatttgagtatggtgggaaagaatgctgtgatggattaatgatgccagccatagttttaggagaatgaaggggtagcatctcaactgtgtgcattaatcaagatattatgccccttagaacatttccatctattttccctgacttaaatattgtatttgttctataggtttcctatttaattgtctttgaaaaattttagtctccctcttagaagtcctttataatgtctatgtgttcatttgatattcgggtatatctttacggaaatcccaaagaaatacagaaattcctgtgtgggagttaggggatgggttgtggaaaaaattaggtttgattctatactcaataaggcagtgtttcagcaagagaattccttgacatttttgagcttctggcttattaaatcaaaatatccagggttagaatcttcatttttaaaagttttataactaatgattgttatgcattctgaaagcttaagaatgattattataagggaacccactgaaggataaattcaaacacgaaggtcccagatatatgtatttatttattaatgccatcatatttttcattcattttactctattaagtgcatatatatataccagcttatatggagatttatgtctttattaatttttaaaattaaaataagatcttactatgcacattaatctggaactttcatttttcactttatatataatggcaattcaccaagtaaataaataattataattcatgtttttaaaataatactataatattccatgatatatcataatttattcaactattccgttacttgttgaaagtaatttcccctcaatcttttgccaccacaaataatgttgaattaaaagttactactacagtatgggcgtgttcttacatattagtgtttgcattttttagcatagcaaccaaaagccaggttactgcatcaaggcatatgtatgttttgaattttaatagatgctgctatattattttccacaaatgaaagaatttttttaaatcagaaacacacaagagtgtttatttcccctggattcatcagtttctggagttatattgatatttacgatttttaaaatctaacatctttaaaaaaaccgggtctcattgatgttttaaggtacattttcctgattgctggtgagactagacactttttgttgtctaatagtgttttgcattttcattttatattaagggcctctttatattcatcatatatgtgaaaaagttttactttttagtctatttctctagactttgactttagctgtggatgaacatttatatattgagtcaaatatatttctgctttcctttatggtttattgttttgcttataagaactccccttccaaagttaggtaatacctgttttctaatacttgtaatttgcctatttaaaaatccttactggaatttaaacattcaggttccatatcttaacagaatccctacattcctttgttcaaaacagtggctaatatgggaactttagacttggtggcagtattgcaaaagatttctttaaaaaacagaaaaggaattagaggacaaacactaatctcattagcagccagtatttactaataaaagggtacctaacccaacctgtaaagcaccttgtaacactccacaaaatgagccagtttcctgaaactgtgtatttgcaatttaaatcacaagtcctcattcatcaacatctgtttaggactttacggtttacaataggcgcccacattcacaatgtatgtgtttgtatgggacatggcaaattatgaaataaaacatacatgatttttatagcctcctaaccacctgagagggagggacaggggcaatccaggaggtgaagggacttactcacactcacccagtaacagtggccttagccccaggttttctgattccaagtcaagtactacatacacactgtcccattgagcgcaatctcaaagtgactcatgaatttccttgcagcagtaagatttggggaagggctttggcaggactgaaagaaggagcatctactgctatctccaaatcattctgttgagctacattgaagttcattatttcactgaattaaagacttaggtaaacaaacacaggctttggaaaattgtaagagagtaagtgtttgcaggagtagaataagatgtttttctgcatctactggggccccaaatcatgctacacaaagaaagcttacctttcctaagccaagaaaccctcccgcttccgtccctttctaacaagtttggtgcaggcatgagtgcaaaccttggtactcaactgtatttgcattgaactgtatgtgcatactgtattgctgagctccacgggtggctgctagaaatagcattgggagtatctggcccacagtgctttgccttcagtcatgacagagccaagctcaagaggcacctgagttaataccctcattactcatctctagaggaaatccagccacgacaaacacaagggcacgtagcaacagatgctgaataataacgatatgcaaattcatcttggaaactgatcctggtcctgctgaacagggacagaagaaactaaaggtggcctaatgaaaatcaggcaacgagctttgcagtcatggcaagcactgcagggtttgccttctcctagctagttggttgccatagaaacccgtgtttgcagattttctgagcgcattaactcaaagaggaggctaacattatcccactccagtgttgttgggagaagtagaataatttggttctaataaatacatatttgacaagggcctactatgtgataggctctagaggaatccacagatacataatgtacatggtgcctttcttctctctactgcctgactcacgagggaggcctgacaagacagcagatagctataatggaatgtgatcagtacactcacacaggtggagagagcagaacaatgaattcttcctgagaattgtagggatttgcagagtggaggtgacatttgagtaggcctttatgagaaggattagaaagagtttgctagtagaaaaccggagtggacgtcctagggactagcttgagcagaggcctggaagcatgacaggttacacagaatgctaagtctaataaaccaatccagctctacagcataatgagttttgagaattacagtcaagtatgattaactcatacttcaccacttccaaatgtgttgattatcatcctcttatgctaagctgaatttggcattatctaaacgagtttctaagcaaaaaaaaaagaaatctaaggaaggatttttatcttcttaaagaaaaaaaatgctatttttaagcactagtagaacatattcctcaacagaaaaggttttagagtcagatgaacctaggtttgatttacctagtaagtaaatgatggtgaaaagattactttaacatttttcaacccccttttatttggtttttacatgtatgttggagataacattttcatcatagaattattttgagaattaaaaaaattaaatactgttattcaagtgcctacaacaatgcctggcacataataactgcttcatgttttaaactatttataaataataaagatttgagccattttatataccatgtgtatttcttctatgatgccttgcaggttttaaatacatctctgacatgcaaaataaatcaatgtcatatcattttagagcttgaaggtataacttgaaagtgatccaattcaatgttgtctgtttacagagaaaacgactaaattctaaggcgcaatttcttacatactcacattacctgactgattagggggtatgcctgacctacgactcagaaatcctgactgactccagggttctttgcccacagaaacacagctgactttcccactattacgcatcattaaaatgcatgccccaacagttaagcctcaggaagtcaccttagagcaatgaatatgcactaaacagtactatcgcttcttccactcaattgatccaaattaccaaagtttaactttccatgcaaaactgaagtatatcataaatttttccatataaatattaacgctgggttcattatgttttcttaaggggaaagttgcctaattatgtgtaatgcttgtcttagcctggtgacatttgtaacattaaatatcaccaacagaacagatcaaaacaatttaacagctaaaagaaaaaaagttttacatttgaattaggttaaggtgaattaagtattgctgacagtattcaaacccacttccagttagaggcatccaagtcaccgacatccaaacaggaagaggcagtaccttccagggctggcccagcatggaactttctctcgctgatgttgccccaacagtcagtctggggaactgtatggatgaaatcatctctcacctctgcctttctgtcccctgtgttatcctataagatgctttctccacttctccaggctccttccattttctccacttttcacagagtcctaactcaataaacgatctcaagcaagtctttccagttaacgtgctctcacaactgttttcccaacaactttcttatgaatcactaacactcatgagctcttagcatagtattgagtactacacagagggctctataagaataaaataccttaaaacttaaccctattgtattctgttataatctcccctttctgatgagcaaaaaggagttaaacaggctaaataactcataagcagtagcacaagattcacgacttaacagcataactcccatctgcagacttaaccaatatgaaaatccacagttcataaaggagaggatggctgtcccacatgcaatcagaacacaacccaaacattcacagacacttacaagcagaaagccacttacagagaacatttagctttgttgttttacagacaaggagacagaggcatagagagggaagtaacctgctcacagtctcattcttcctcattctgattgtgcatcttcaagaaatgtagctttggtttgttaaagtgaactaaatatggcctgagaaggactctgtacttctatatttgagtccttgtggaccaaccttaacctaacttaatagacaagattgaaaacctaacttatgcgtctgttacaatacctgagtcttggccaatcttcagcgactcatacagcagccatacttccaccactcatacactgctgagtgctcaaactgttactataaggcaaacaccaacctgtaaccaatccagctgtttctgtacctcacttccgagttctgtagtcatttcccttctttgttccataaatttattctgaccatcaggcatccctggagtctctctgaatctgctgtgattctggtggctgcctgatatgcgaatcactttttttctcttcctcaattaaactcccattaaatttaatttgtctaaagtttcttttaacaggttccttggcttaggtccttgaggcagtgactgtgcattattttttcttgggagtgagatagcattaaactaataagcatatttgctgctgcacatagggggtcaggtgaggtaggggttggagcaaggaagctgaagcatcaaaagaagttgagtcctttgcccagagtcactttagctgtgacagctggcctggtatttactgtaatgagatcatgtggttttcagaacatgaactatctaatgtttaaatgttaacttttacttggtagcaatcagttaagctgcataacctcgtggaggaccacaacaaagtccaggttacaatcattgtaaaagacaaaggtaagtgatgtgttaggccatcttcagcatcttaatatttcaggggggaattggtctcatttgtccttaattattagtcaaggagaaataatcttttcagattgaacccagaactgggacgagggtgaggcaaagaagccctctaagatagaaaatttaaagaggcaagatcatgccagtgctgaccccacagctgcagggccctgagaacaagggcctcattgaattttgtacactggacagcttgcttgccttaccctcacccaagccctcattccgtcattcttacccaatgtctgggttccttcaaattccctctccccttcacatgtcactcattcgaataacattgggtaaaccttcttaaggttcctttatttcccagtctaactatcccaaacagaccctgcatcacacaatttgaactgccatctggaacctgggcctgaatggggcttttagatagctgtctggacacttggcatctgttctgagctagtcagaggtggagtggctgtggctttttgcaaggagcgaggagctgcaccctgggacagcagaagttatttgggcaatttaagtaaggcctcaatccaagaagacaaagtgtaccaaccacaggaatcagaaacccggacgagagcaaacagcaggaagctgcacttctgctttgcccagtgcccttgtgtatctgctgtgggcaaagcacaccaggtactaggatcaagatgggatcctgttgcttagctaatccttttctgagtcccaggaaccaatttcctaatcctgattctttcggaattttcaattgactaaaaaggggcttcaacagttgaacaggtagggtagctcttggccaacaggttgataaggattcttagttgccttcattcttaagtaaaaacaggaaaaggtcagctattcatggaaactttgctttggtgtaggtttggaggagctggaatcccgtctcttggttcccggagacattcttattcttccaggaaaattttcattgccatgtgatgctgttttgattgatggaagctgcgtggtgaatgaaggcatgcttacaggtaggcagttgtcatggagcttcctcttccctgtctgacatctaatcagatcaacatatcctcacctaccttataccagacccttgctaagatattcagagataggtgagggagacacagccagcctttgcatttatatggagacacaatatacacaaacaggaaatgtttaacaatataagaattaagtcacaataaatgtgaaatgaaaacaaatgtttaatatgacatgtgattaattgaccaattagtggggtgaatagggtgctttgggttcagaggaggatgagagcactacacagtttgaagcacaatctcttcataaacatgagaatggtttatacacatgtacaaaagagatgcaaccttaaaaaccatgactcccacaattggaaggccatagaggttttatccaaccctgcactctgtagatagaaaactactgaggccaaggtttcacaggaaaggagtttgagttgaacctccgggcaaagacgatcgcacagttctgttctttagatttatattcctgttgatctcactgagcagaaactaatcttctagttatagttcaggcagtcctagttctcatttgtactttgttaagtctacttgaatttgtttaattagtaagatactacttataaaatattctttaggcaaaaaattaaaatacacagcacattgtaatgagagaagagactatacagcaacacagaaatagaaactttgtcttttatgcttacagactgtttagtttttctgtttccaaatggtataaagacagggaaaatgttttaacatgacctaaatgtagggagagttcattatctatccctaaattgttcaacacaagcagattttacattaaaatgggtctgcttaattcaaaattgagacaagaaaatgtagttaacataaatatgttcagtataattacaaaatactcctttaatgtgttgaaatgtgtcctataatgatagtgatgaggatttgcatactgatcatatcttttacccagaatgttgccatagtatctgacctgtaaacctcaagcccaaggaaaactgtccttctcattcaaacacagcagctgcctcacacctcccagcagcctgacagtgaagaatgacttctctcattggtaacagagagtgtggcagtgagcagacatggggaggaaacacagaaagtctcactgcccttgggctgccctctctcctttcactgtagcgggtgtatagaacttgccttgattcccaggaaaactcagagagttccagaggaatagaaatgacaaacaacgctgcctttcaacaaatgtgcaaaatggctccaaataaccttaaatgacaagtggcttctagttttcctttttggaaaaacgaactcatcagcactaatatctgtgtaacttaagtaccgatagaggccagtttcagagacagacacatgaagtaaaaatacattatttcttttttgttaacttcttcagaaagatctaaatcccagtctggtctaaatactttattgcacagcctacatagatcctcccactcatgtacatatttgtggaaaggatcttgattaaacagaggattaaggtaagattcctgaaactgcaaatgtattcctagggaatttgtccacaaatatgatttaggtatttcttccctatgtacgaaatggtcctttgcatagatagaagtctttatttatgtaagaataaaaatatcaaatattcctagcatctctatagcaacttacattttataaataacttttatatctcacttcatcatggtataaaacaaattagactaggagctgttagaataccgatttacaaatgaggagagtgaggtaaaaagaccagagctgctcggctagcaagtgaaaggatcagaattggaggtggcattcgctcccaaatataaaggaccataggcgtgagaaagataattctaagctggaaaaagctgctgacttcatcttcctgcctcatcacctttttctccctacttggtattcccatcaatagtatccactttttggtaagctcttctcctcctgctctccttagccttatgctattgtcataaattcagctgtgcaagaagtttacctttattttataactacacttaatttttatgtcggttccaaattttgccatccttaaaagtgtccagtgtgaatatctaatatgagtcagacagttgtccccatcagttaggtggtcttcctcacccttgtctgactgtcctaagatgtgcaagacatcagggagaggggtctgatggagggcagctcttcttcctgctgctcccactccactctgagctgtctgaggcctatttacctggacagggcagcagatcctggtgctgttcgcgctgtttccacaaccttgttgcatgttcccgtgttctactgtggtgcacacctcttctctcagggacacaccacatctaagtcccgttggattctcttccaactcccagtacgaggactttgatttagctagaaatgcagtagaggaaaggcatggtgagcagaaaaactttgttcttactctcagatagtctctcaatccatgatcaaactcatgaaggacttcaaaaactcaaaagccagtgatcaactcccccgtccttctcttctgctgtctttcctgaaacaataatcaacttcaagatctagcttctctcaaatgggaggagtctggagacaaaagggaatatcatttgggagggggggggaatatgttaatttagaaattatctcttggcactatagctttttttcttagttctcatatgtattaggcattgtgctaacattttacatatactatttcattcaacctgcaactctattagagtgggcaaatctgaggcccagaaagggtaactaatttgcctaaggtcacacagcttagaagtggcacagctgagatttggatttgtttgtgaattcactcattctacagatatttattagcccctactatggagcaggaactctgcaggtgacatagcagtgaaaaaggcagataagatttctgcccttgtggagctgatattctagtgacagagacagaaaacatgaaagtatacaaatgacacaaattttcaacagttataagttatatgaagaaaacagaagacttctattgtcttaataaataaatttaatgccttaaatacaggcattttgtccccagaacctaggcttgtaatcagtgtttcctcattctcttagggataattatggcgaagaggggtggcatgcactctgccgcaatccccttccctcttcttctcttcattaagctgctgatgtatttgagatgtgtgtggggcgagagtgcagtgacctgagttggacatgcagggattttcctaagtgatgatctcacatcgatatcctgtcagacgagcttatcatcagttgataggtcagatctttttctctcttcctttgatcctttcgtcctctctttttatcatcctccttctccctttccttttacttatttgttcatccatttactcaataaaagctcagaaatgcctaccatgtgccaggtactgtgttgcgtattggtgtcaccaagttaaaagagaaatggtctctggtctcaaaacatttacagtctaatggttctagaactataaattaaaaggacttggaatttcaaacactgtcaccatgaagaggcatcttgatccttgtggacaagggagagaacctccacgtgacagcacagggagccaaatgtacagttgattatgagcaatgatggttctttcctctaaaactctcttcagctgccttggaccccacatcttttgtagatgaatcatcctttcttgggctccccagaaaggccaaaacatgaggcttcttattaatatgcaaatagcataaaagagacttgaaaaccatctctctgtaaaatcatctgactattatctctggaacaaattatctgcaaatgacttccattactgattgatcaatacatgactgcctccagtttcattggttttgtgtgcagaaaacagtttactgatgttagcctaagtatatattgtggattaatattctgtgattcaaaagcaaaaaaaaaggaaatgatctctaagtattcgcctcttacaaaggctgatttcaaaacaatgtagtaccataatttggagatttgtcaaaacattctaacccttctacgaagccatagaatgcaattgatacatctacacaatggatgaatatcataattgttttaaagaaaatggcatagggaacaacacttgcctaaaagaatttcttgaaaaatattcaagattgctaataacaattttatagcttcttacaccttagcatgtaaaaatacatcacagcagaaaatgagttttgaaaaaccaatcatagagaaacttgggcatttttatttaattcatctgcgcatttgaaaaaactatgtgttttcaatataccagaatctctgggacacatttaaagcagtgtgtagagggaaatttatagcactaaatgcccacaaaagaaagcaggaaagatctaaagttgacaccctaacatcacaattaaaagaactacagaagcaagagcaaacgcattcaaaagctagcagaaggcaagaaataactaagatcagagcagaactgaaggaaatagagacacaaaaaacccttaaaaaaatcaatgaatccgggagctgattttttgaaaagatcaacaaaattgatagactgctagcaagactaataaagaagaaaagagagaagaataaaatagatgcaataaaaaatgataaaggggatatcaccaccaatcccacagaaatacaaactaccatcagagaatactataaacacctctatgcaaataaactagaaaatctagaagaaattgataaattcctcgacatatacaccctcccaagactaaaccaggaagaagttgaatccctgaatagacaaataacaggctctgaaattaaggcaataattaatagcctaccaaccaaaaaaagtccaggaccagacagattcactgccgaattctaccagaggtacaaggagaagctggtaccagtccttctgaaacaattccaatcactagaaaaagagggaatcctccctaactcattttatgaggccagcatcatcctgataccaaagcctggcagagacacaacaaaaaaaagagaattttagaccaatatccctgatgaacatcgatgcaaaaatcctcaataaaatactggcaaaccaaatccagcagcacatcaaaaagcttatccaccatgatgaagtcggctttatccctgggatgcaaggctggttcaacatatgaaaatcaataaatgtaatccagcatataaacagaaccaaagacaaaacccacatgattatctcaagagatgcagaaaagtccttccataaaattcaacagcccttcatgctaaaaactttcaataaattaggtattgatgggacgtacctcaaaataataagagctatctatgacaaacccacagccaatatcatactgaatgggcaaaaactggaagcatttcctttgaaaactggcacaagacagggatgccctctctcaccactcctattcaacatagtgttggaagttctggccagggcaatcaggcaggagaaagaaataaagggtattcaattagaaaaagaggaagtaaaattgtccctttttgcagatgacatgattgtatatttagaaaaccccatcgtctcagcacaaaatctccttaagctgataagcaacttcagcaaagtctcaggatacaaaatcaatgtgcacaaatcacaagcattcttctacacccataacagacaaacagagagccaaattatgagtgaactcccattcacaattgcttcaaagagaataaaatacctaggaatccaacttacaagggatgtgaaggacctcttcaaggagaactacaaaccactgctcaatgaaataaaagaggacacaaacaaatggaagaacattccacactcatggataggaagaatccacattgtgaaaatggccatactgcccaaggtaatttatagatacaatgccatccccatcaagctaccaatgactttctacacagaattggaaaaaactactttaaagttcatatgcaaccaaaaaaagagcccacattgccaagacaatcctaagccaaaataatgaagctggaggcatcatgctacctgacttcaaactatactacaaggctacagtaatcaaaacagtgtggtactggtaccaaaacagagacatagaccaatggaaaagaacagagccctcagaaagaataccacacatctacaaccatctgacaaacctgacaaaaacaagaaatggggaaaagattccctatttaataaatggtgctgggaaaactggctagccatatgtagaaagctgaaattggatcccttccttacaccttatacaaaaattaattcaagatggattaaagacttaaatgttagacctaaaaccataaaaaccctagaagaaaacctaggcaataccattcaggacataggcatgggcaacgacttcatgtctaaaacaccaaaagcaatggcaacaaaagccaaaattgacaaatgagatctaattaaactaaagagcttctgcacagcaaaagaaactaccgtcagagtgaacagacaacctagagaatgggagaaaatttttgcaacctactcatctgacaaagggctaatatccagaatctacaaagaacgccaacaaatttacaagaaaaaaacaaacaaccccatcaaaaagtgggcgaaggatatgaacagacacttctcaaaagaagacatttatgcagccaaaagacacatgaaaaaatgctcatcatcactggccatcagagaaatgcaaatcaaaaccacaatgagacaccatctcacaccagttagaatggcaatcattaaaaagtcaggaaacaacaggtgctggagaggatgtggagaaataggaacacttttacactgttggtgggactgtaaactagttcaaccattgtggaagacaatgtggcgattcctcaaggatctagaactagaaataccatttgacccagccatcccattactgggtatatacccaaaggattataaatcatgctgctataaagacacatgcacacgtatgtttattgtggcactattcacaatagcaaagacttggaaccaacccaagtgcccatcaatgatagaatggattaagaaaatgtggcacatatacaccatggaatactatgcagccataaaaacggatgagttcatgtcctttgtagagacatggatgaagctggaaaccatcattctcagcaactatctcaaggacaaaaaatcaaacaccacatgttctcactcataggtgggaattgaacagtgagaacacttggacacaggaaggggaacatcacacaccggggcctgtcgtgaggtggggggagtggggagggatagcattaggagatacacctaatgtaaattatgatttaatgggtgcagcacaccagcatggcacatgtatacatatgtaacaaacctgcatgttgtgcacatgtaccctagaatataaagtagaataaaataaaaagaaaaaactatgtgttttgaacctattacatatcactaggaaaatgaagagtatacaaatttatatatgtcaaagttcttgttcccagttatgacctagaaagagagatgagacctaaatttgtataactatgattgatataatactatttccaaattagaaatatgacaagttatcttgctaattgaacatttagtaaaagactgatggaattttaaattcattctaatactctttaaatcttggagccaaaaattattattaacatctttattttgtctctgaaatgtatcctttttgaactctgagctgatttctttgtaccttaaatattctgtcttatagccaccagggaaaggaaaaaaattgctacctgcaaagaatgggggccaataaaaggaaatgcaagtggcctagttgagctggagcttttgtaggggaatgtcaggcaatgatgtttgaatcatggtaggctttgacaatctagcaggagagtttggtctttattcagtagtggcaatggaaaaggctaacgattttgagcaaaagaatgagatgataaaaatgggacttggatgggatccatctgaaaatgatgtggaataactactattttctcaccttgctccatgagcttatgagggcaagatttctgtctctcttgttcatcatattcctagcacctagcacagttcctggaacagaataagcacctaaaatagctgaatgaatgggtgaatgaataaacaaatgaataaatgagtgaatgcaaagcaaatagtaattactattcacgtgctggaaagctccttcattgcctaaaatagtgctgggcttaatgaatgcttgggagaatgattcagtgataactcatctataataggctgcttttaaaattatgacaacaaaccatgcaggccaggtataggatagataggcagatctaatctaaatatttgcaatagaatcaagtctaccattgcttgtaccaccagcatctctatgaacagtcatctgactcatgggatgggcattaagaccggattagttgtggtttgtataatttcttgaaactggcatgcaccagttctgaccaactacctgagcttacatagattcaacaaaatacaatcctctttaggagaaagtatacctgttacaaagacaccattgccccagatggagaacactatgccttggaaatgtcacagtttggaggattataggaaacacgtccttttctgtggaacagaagttatccaggtcaagccctctgggcaggggcctgtacgagcagtcgttttgcaaacaggttagtggattccacttttgtaagtttaattcatgcttgaacatggggagagttggattagggaaatttagtttaggattatggagtctgccacattctggtagtaacaacatgcttttttccaaacagacacttattattctaaagtgtcactatttttaattaaatggtttattggtaaaacccttctatgtgatgaagggtatgtgtaggtgaagtaaaatttgtcaaaggtaaaactatgctcttctttttgcttgtgaccatacgctgcttctatctcccttgacacctcctctgagtgattaccaaaaaacaatttcagccaccacgactatgaggattttttcctttcaaagagttgcttgctaggctgtatgtcaaattcagtaataaagaactccacctgggtgccctatagaccagttaaagccaacgaatctgaaactattcatcctcctgtattgactttctctgttaatatcatcaccatcatgctggtctcttaataacatctccaactcctcttgtttcccataccaaatgtggcaccaaatctggatgattccgcaaacacttcctgagtcccagtcttttacatgacgtgacacaatgaaggcctcctatgacctggtcctagctctctgttctaacctctgacctctgtttctgccacccgacttattcacagatgcaaaatacactttacactgtgatacctgcatgctttagtttggtttatgatttagttgttctagctgattttttaaaattaaaaatatctaatttttttaaatgttcaaactagttagcaggcactagacactagagcattgctcagcctgtggcctacatggaagctcatggttaaaaatcatgaaaaccacctgaaaacttataaaatgattaggtagaaggttagaggacactctactcttttcctcaaagacagtaaagccatttttaggagaccaagtgtccatcaagcagccttacttgatctatgattatctttatgtaggttacaatacagccaaaggggacttagtgagatccatcctgtacccccggcctctgaacttcaaactatacagcgatgccttcaagttcatcgtgttcctggcctgccttggtgtcatgggttttttctatgccctaggggtatatatgtaccatggagtaagtactgggggtaaggcttttcaatagtatagattctgcaaagagcttgacctaactcagaggattggtttaggttacatcttgatcccatcattctgtgaatcattactgtccaaaagagcttcttagacagcggaaatgttctcatgcctagtttgcccccagtgtttaggtaatatctaaaacactatgcaatcagtgggtttcccatgtgttctggttagggtctgaaatgaagttaatttccacttttacagagctggtactgcatgagatacctacttccctttaagctacagggtgtcaggtttcatttggatgctccttgtcatagcctggtggctagggagggaagggttgtcactaaagacctctgaggtcctttctggtcctgagagtctgattttgctgtgaaccagaaaataagaaagtctgggatcataacagtgtgagctggtggggaggaagagaaaattgtgaataaaacatccaaacaggtgaaaaactgtgagtggcttaattacaatgtccaaattggtggcatcaatgagcgtgtgtgtgtgtgtgtgtgtgtttgtgtgtgtgtgtttgtgtgtgtgtgtgtgtgagagagagagaggtgggcagtgaatattggtgggaaaagacatagtaacaagaatttcaaggcaatgttcacgccaaaacttaactgctgagtagttatttcaatctgaaatagctcccagggagcatttctgggtcaagagaggcccacgatggggcctgtgaagagctaggcagaatgtcaaggtcactggggctggaatttgagggagtatgccaatttaatctggggagctggagcattgggcagaaaagcaggaaaaaagctcatggaagccctggcagtatttgagaatgaggtttcctgggaagaacttaacatccaatacacactgaggcaacaagactaataatcccagaccccaacttcttgtgggtcagaacctgtggctctgttggctgcctctatctgcactggttcagcgctagacaaggctgagtccttagggtcaaaactcttccgtgtctgtggttgggaaaagaagggagtaatgaattttgtgataaattgatattgggcaaaagatgtcccagcagacattgctactgaacttgaatcccatgtttccaatacttaaaaaagtatttatggctaaaatgatggttaatttaacaaaaacataggtgaggttctagagggtagaatcattaatatctagagcatgtgaggaaaacaaaacaatcaatcagtcaaccctgtgatttgacctcatccctgaccttaattgtgtgagcctcctctggagacctgctgtattagtctgttctcatgctgctaataaagacatacctgagactgggcaatttataaaggaaagaggtttaagagactcacagttccacatggctggggaggcctcacagtcatggttggaaggcaaagcagaagcaaaacatgtcttacatggtggcaggcaagagagtttgtgcaggggaaatcccatttataaaccatcagatctcatgagacttattcacaatcatgacaacattatgggggaaactgcccccatgattcgattacctcccactgggtccctcttactacaggtgggaattaggggagctacaattcaagacgagatttgggtcgggacacagccaaaccgtatcacctgccagggatcctgagttcacaaaattgacttgataataaaacatattggtcatgggtttgtaccctgcagtaagacagaatagggttcagatttctgtcatttacctagtatgtggccttgggaaaattatttaattgttaaaacctcagtttccttacctgttaaatggagaaaataatagtatttacgtcataaggttgttatagagagcaactaaataatatacgtagcctaatacagttcctgctccagagttagtatccagtgagagcaagctaattttatattggcttctctgtagttaataatatatgctgagatcttggaaggatgttggtcctagtttttaattatattgccatccattcaatctatgtcctgagcacctcctctgtgctaaatcccatgctaggctctgtatctagagatcaataaggtagattcaaagatgaataagccatagctgctacacccaaggagtttgtaggctagtgggggagagagattcataagccaacagtcaagcttgggcagagggaatgctaagtagagggaaacagaaccaggaaaggggttggtggactgggagtagggatcaaaggtctcctttgctctgcagtaggagacaatgtgctcattcctttggcactaggaagggtggcagtctgctgtgctgggctatcctgtatgaaaatgtctgtcctctcccaggttcctccaaaagatactgtgaccatggccctgatcctcctcaccgtgactgtccctccagtgctgccagctgccctgaccataggcaacgtgtatgctcagaagagactgaagaaaaagaaaatcttctgtatctccccacagagaatcaacatgtgtgggcaaataaacctcgtgtgctttgacaaagtatgatccagacttctcaggtttaatgttaatgatttcaaggcatggtggagctgggaagaacctcagaaaatgtctagtccagtgttcccattttacagataggaacgttgaggccagagaaggtcacagagtgagctagtgcaagatcacattctaggagcctgctctgctgactcttaaggttagcagcttagccagcacatcatgaattttttatctgtgaaacttaataatttgtgtgcctggtttgtggtttttttaaaaccatctcttactatgtaacttcttagactgactgacttggcagaaaatgtgaggaacatttctgtttcctgaaatgttttgtccagaagataagtgaatctgtttcctctctcctcctctgcttctttgaaggaaaggaaggaaggaaacaatgaccctgtcctgcccctttgctcctccagggcttgtgactccaggctaggttgtctctgtgcttagggacctggaaaggtggcagaggaggagcatatgccacatggggaacactgcgtttaccaagcaggtcctgacacccccccatgacgtgagtctcctatggggaacctggaggacttcagcattagctgcctgctatttggatcctgccctcagcttggacaggccagtttaactgctgtaaagcagtgggcctggctgggtcccttttgtcttcaattcatgtgcatttgaataatttattagggcctttgccattttgtggcagagagccactgctgtgtacaatgctggtagagagtcccataatgagtcattcctagcccttgagaagcttctagtctagctgagaaagcaggaaaatgggagtgtagatggcgatcatgctgtgagatgtgtgtttaatagaggcctgaggaaagcgcggggcacagttacctgccacggttggaggccacctttgaggtgcagccttggttgttagaaagaataagccccaggctcagagctgagcagctgacaagcacaggggtacaaggggcccactgcatgtggggaacagaggaccatggggtgtggctagaatatgggctggtaggtagagaatgaagctgggttgagggcaattgttaagggcctcatatgccacgctaaggagtgggtccttgtcttgaagcagaataggagcctttactttttaagaagactggtgacatttctttaggtgttttctatcccaccaggggcaactggggagatgggatggaagggagacaagactgaagaaagaggccatctggggacaacagaagagatcattgcttgtcccagacaaaaaggacaaggatggagagtagaaggcaaatgggagtgactccaatgagtagactcgaccaggcttggtccccaggtgaaaggggtatatctcttaggttatgtcagttctctttctgtttgtattttgtttggcaaagaaagttctcgatcaccaccagtcaagaaccgacaaggttaacttcattttagattcagggccaaataacacccccttggaagttctctaacagggattcctgttacttcctcatgagcctcactggtgtctggaatataagagggagacttatgaaatatgttcattacatattcaactgtttctaaaattaattttcccgaggctgttcactttatttcctgtataaaacctctccctccacatcctcatgtcctcacctgccaggctgtctgtgaggctgcttttaggtgtccttggtcaaactctgcagggcatgatgacacgtgacagtgcaaaaaactcttgattgaaatttggcaaaatgagaaatctgacccagaatttggtactaagtctttgtgtgacctttttttttttttcttttgagatggagtctcgctctgtcaccaggctggagtgcagtggtgcaatctcagctcactacagcctccgcatcctgggttcaagtgattctcctcagcctcccgagtagctgggattacaggcgtgcaccaccatgcccagctaatttttgtatttttagtagagacggggtttcaacatgttagccaggatggtcttgatcgcttgacctcgtgatccaccctcctcggcctcccaaagtgctgggattacaggcgtgagccaccgtgcccggcccatctctgtgtgactttttaagaaaagcagattcaaccacaatcgtctctgagtttctttccagctttcacattataaaattctatcaccatcatgttggaataaagcactctgccattaattgaattttcatctagtgttatttccagtttcggagatatctgtcactgggtttctgagtccatttgttctcatatctatttctattttctattggtttgttataacttctgtaagacaagttctttctttttattcaattcagcccaagcctgggcttgaatttatgctaagaggttttctctttctatcttattccccttagaacctcaactataatttagttttctctatttatggttagttttattgttaaggggtcattttcatagagagataacataatctaatttctgttttgctgcagtatcatctctgttttcatgttcaaaatattgatgtttaaaaacatcatcaggaaaacatatcagtttgaattaagttgcaaactctttttgaaatgcaacaacttgaggggatttggaaaccgaacatggtggagtcctttataaaatgcaggagagaaatgaaacaaatagctctttttcaaaaagttgttgtttaagaaataattcactcgtgtgttagcaccttctttgtgaagttcaaataaatgaatgaaacaaagttttcttaattatttaatctagaaacccagaaagagctttgtctttccacataccccgtatgattcacttaacatttgctagtttggaggaagactccagaagggctggattttggttctgcctctccaacctacaggccactatgacattaggctcctcatttcacctctaacctgcctccaccctgttaactcagttgtgaaatggaaagcattgtaaacactttcctgtaaagcattatgctaatggatgtgctataatgacggaggttgccattttatagaaaactagaaaattcagtgacttctatagagataggcttgaaaagtagtgtcagagacttggatcttagtgttgaaacagggtattctgccatgcttggtaaagctctggtgggccctggcagtgctgaagcagctagctgtagccaactcacttactcagggtgttaagcaggcctaaaactgttagcctactgcatcaagacaccagagtatgtaattcatcaacacctgtgaaacaatgaggaaattaaaagtgctgtgatagtactcggctccatttttctttctctgtttcattatctaacaaatactctcccatagtatggcgaatcaaatctctgaactatttttcccttgatctaaaaataaaatccacttatgggcattaattaatatttattattagcatttactttctctctatagtctcaaagccctttatcaacatttcattatcaatctggacagtcactgtgtcacccatatttttagaaaattactgtgaaccagatggcaaactgtgaactgaacagtctcgaaaatgaacaaaaaaaaatgagctctgcttcagcgagatagcaggtgacaactaaaagtcagactcgagctgattcttgtactgaacctctcctggttaacaacagcaacggtcatagcaatacacaaaccaaaccaaaacaaaacactttcattttttcctcatcattagtaactgaaatcacctaattatcgacatggtcttttggggatcatgtatcacctgcttaatttttcttgtgggtactcctctctgatttaaaatttggtacttataaacaaggtatttagactactggatctactataatatcttagaaacttgggttttgtttaaattactatataattaaaagctttaaatcttatgctaatattgcttttaatttttactcagactggcactctcactgaagatgggctggacctctgggggactgtccctactgctgacaactggtaggcctcttatgtgaaaatggaaggtgtgtttggtggagttacctggatgatactcaaatccatcttttgggtgttaagggatgaatgtcacataaaatatatacaatagttggctggaactagttcctaattattctaacttgcttaaatgaattctaatttcagaatgagaaaggaaaagtaggtcttcaaaatctccatgaaaaatggagtaggatgaggtggataattaaggaactaaatgaataaaacagagaaaaaagagtgaaatgaagaccatgcttaattaaaaactacaaaacttcctgggtggctagcgcaggcaggtggtgtttcacagtctagcgggataaaaaggtgcaaatacacccacctttgatgtacaacacaggccatgaaaattgttactattaaggcagaaatgtcagaatggagaagaagaaatggagattatttgatataacacaaagtcctgacttttatataattacatggtgggtaaagacaaattaattttgaaatttagtgaatcaaagaaagccacctgaaggagatggcacttcagataggttttgagggacgtgcggctagaatttttacagctgtgggctaaaagctggcactagggagaggagaggacaatcacatagatgtctactccagaaagagctacagaagggaaagagggcccctggagggtgaatctcctcatggtatctccctgtggcttctagctccttccctatgggctaagacttgccttctcaatttgagcggcgatggcctctgctcttaagctctaagtaccctattttggtgccaacagtggctgaggctgctgtcagtgacagaagacactttgcaggggactcccaagatgacgaaggggccaggtaaagcatggcacaaggtaacagcagacaagcagtgtgatgttgcagaagataccctggactgggtgacaaggaacacctgagctttaaccctactgatgtgtctctgctcctggtgctcagatgtcccggccagccctttgcccagacaggcaaggaatctattggccagagcagtgaaagggaaaaaagatgtccacagtttccacccctccatcttcctcccttgtctctggtactctgaaggttttcggagactagaaacaactagacacaatcactattcagctgtaaggtgggaagagaggaagatacaagataccagtttgtattatcaaagagaaaaacaggctttagaggtgggatgtccagggtgcttcaagaagtaggggcaaactctaaagggctgagacgtgaaaaatgcttctgcatccatgcagccttctttcctatccctaatttcctgctccctaagtagccctagagacttcttgcctaggctgtgtggctttctgcagacagctctacagagtttgcaggtatgactcccagctgcctgttcagtgccttcccacaatgctgccattatgtgggctggcttcaagtaatatgaaaaaagtccctgcaattctatccaaagcctctgaaactatgttattgattggccagtggaaaattctgttgagaacaaaattcatatccaactcaaagaaatgtttatataaagataactctgtaggcaaaacaccctgtttaaaaaataaagaaaccaagtgggcaggggcttaagagcagagaagtctctggacaagcatagcaatagcaagaagtttaatgtggatctagagtacagggcatagaggacattagtaggagtggacactgtaaggtaaggtagatccgaagtggacaagactttgaataccaggctaaggggtttggactttatcatttggagcatagggagccatgggaaggttctgagcatgaacgttaggtgtttggagctccactttagtaagatttaagggacagaatgtgcaaaatgattttatcaaagactttaacattaccttctctaccagcttccaggaagcccacagctttgcctcaggccaggctgtgccatggagcccactgtgtgcggccatggccagctgccactctctgatccttctcaatgggaccatccagggagaccctctggacctcaaaatgtttgagggcactgcctgggtaaggtgatagtttaatggaaagatgagaatctgaggaaatctttactgggagtgctgaagcttttctaatttttgttaaaacacagagaaggttcataataatgtatgtataagcgtgtaacactaccagaacttcccaacctgtgcccccaaagaattctgttaatggttgctgcatgaaataggcgtccattattgaacaaacttgggaactgttgtttaaacaaagttaaactcatttcttgactgcctgatttctttaatatactgtggtgttttgtgaatattcaagagggaatatgacatgcagcatttaccgaacctatctgacctcaaaaaccttactgacacccataacccagcatgttctccaaaacatcagtgttttccaaaacactatcagagaaacagtagtcaaaagcagtgttctctggtagagcagccacgagccatatgtggctactcagtccttgaaatgtggctctgcaactgagaaactgaatttttaatctgatttaattttaaatagtttaaatttaaatagctacaagtggctggtggcgactgtgtattgtaaagcataagtctagacaccaaactggaggactgcattccaactggttcaatctcctgagctgagtgtgaatgaaaacggaagggtataaacccaccctgaaggctgccatagtggaaaaccctctgcatttcaccactctccagctgtgtgatcacaaagccagagccaggactgagtctgtgacctcatctgtacgtttggggtaataatgcctcattcacggacttatgaccactgagactatgaatctaaaggggctttgagcacaatgaagagccaaacaagtagagggtgttcactaattaactggttagttaattacaccctgttgcctccgaagaacatcctaaagctgtgtccaatgatgtataaaatacagtacagcagttaaacatagctgcaaaagaatgggaacaaatgattgcagggaaacaaagcacacctaacaaagaagctaatacaaagacatataatagggaaattttagctttctagagggcaaatcaatgaaagaggaaacctggtaaaaagggaaacttctgataccagcaagttaaaatagagcatttgctgtggaaaaacatttgacatagtgaccaattctctggatctcaatggagaggaatcggtgtatttactataagcagtgtccttaacagaatcattgggataaacacggtgatgagttgtgcagggtcattttatatctggctttggtcctggccctaactacatccccctctccattataggagggctgatctgtctttacaaataacatacttggttgggaatataaatctttagtattagctctgtaagaaccatctgttaagaatagttgtatccatcccaaacaaagcataaaaatgcatgatttttcactgagtttagagctgtgtcagaagctgtcttgagtatcttttggtaactgggaaccttccactccacatacagaggagggaaactgtccttttagactgtcaagaattttagcatttgatgggatgtcagaatatttttcagaagaaattgagatctacagaaataaagtggtgtccccaagattaaacaggtaagtggcagagtggaaaccagatactatctcctgttttctgacctctactatttatatatatgactgtctttcccatattttaatattggttaatattggcttctcagaggtattaacttctgttgtaatatccaaagaatacacgtcattttcaaacaggctttctaatttgctagcagctgacataccaactccctagttaactcaattaggctagtagcataggtatagtatgaagaactagtgccatgtttatctcaggacccagtcctaactcatctgagagctatggtgctcggcaatgttggagactacatctccacttaatccctcctccaattactagatgtaatcatttagaaagatccatggacctgtagctagcacttcttccatcaattacttcttaaaatgaattcacaatatttttggcttttgacattctacaataaggcccctaatataaatcgatacaacagaaatttgacaatgacagtattaagataattggcctggaagagaaaatatgtaaaaatggctttgaaaagattaaagtattgtgcaaataagagatatttctttcttaatatttttattcaaagaatcttatgaatgttttcattttataacagaaaatggaagattgcattgtagactcctgcaaatttgggacgtcagtttcaaacatcataaaaccaggaccaaaagccagtaaggtatgatttccttctttacatcacatagctctttccccataaaactggtaaaacatttctgacttgcacatatttttatagtcctattattttgccttatcataacagtttccacggttggtttgctgtttctttcatttccgaatttgtctattaatttattcaacaaacactacctgtgtacgctagggcattgtgctaggtgctagcagataaagaggcttcaaaacaagacacacttggctctgggttggaggaacaggtagactcatagaaaaatcaatataggtgcagataagtgcaacacaatgtgccaaatgctataatcaaggctgaagaaagagtttcaagagtcctgacatgggaatgaatactgtttctgggagataaaagcactgcagaggagatgacctgtgagcttggcctggaaggtgattaggatttctccaggggaaggtccttgcagtccagacaacttgttgagggagtcactttaaggcagccacacacacacacacaaaatcaatgttgtgacaaatatactacatcaagatgtctctgggctcattgcacagtaaagcccttttgttggtatgcatttggaaatatcacttagcagcttgttaagctccctgttgttgatgggcttgcagagtccagtggaagccatcatcaccttgtgccagtttccattttcctcgagcctgcagaggatgtccgtgatcgctcagctagctggggagaatcatttccatgtctacatgaaaggtgccccagaaatggtggccaggttctgcagatctgaaacaggtactaacacttttctctttcaagaagtaaaatacttttgttttttctttgagacagaatcttgctctgtccccaaggctggagtgcagtggcacgatctcagctcactgtagcctccacctcccaagttcaagtgattctcctgcctcagcctcccaagtagctgggattacaggagcatgccaccacacccggctaattttagtatttttagtagagacggggtttcaccatgtaggccaggctggtctcaacctcctggcctcaagtgatccgcctgcctcagcctccaaaagtgctgggattataggtgtgagccaccgcggccagccgagaccaaatacataaagccaacaaacacagaaagcttcacaatcaatgaacgtggagctgcttgtttcctgggtaggtgcaaagtaggcccagtagatcctaagaagcaggggtgataatttcaaggctgggaggcagcgactaaatatctggctgtgggtgcagtaagaaaagtacaaccacagtgaggcatctgggaaggagacgagatgtgaagcttgcatcaggagccagaatagggagctactgagggtcagagaactaggggaggtgtgaatgagggaaatggagaggtctggacgctaggtaagttctgcagacatgactgctctgtcacctccagggagaatcagatcgatgggaggagaatatagaagaatatagaacagaaataaaagtgatcagagtaaattcaatggtattagagcaagataattcataattttcacagcaatttcatctttctgggccagactttgagctgatttgtattgctttttagtcttataaacatatgcactctttaagcggcagccagatgtataagaatgttgttgcattcaaatgagttcatttggataaaattggtctttttgtcttccgattttcatgtagactctccttatgattgctgatggccatcaacttgtgcagagaattctagatttggcaaataattcctttaacttctctattgggagtctttttttagccccttttcttctgtctttgatcttcagcataggtcacattaactctgtccttcactgattacaacatatactgtgtttgttttgtttcagttacacgggtacagctgagcatcttcttgacatttaaactggtatctattgtccctgctctctcagtaaggatttgggcctgtcacttggcacttgttttcctggcagctctttcagttcttcctgttttcccaacttccaatctttgacttacgctaatactatcttcagtgatttccaccaccaccgtaccccatttttagaaatagagagctaagaactttcttgaaattagattcccacctccaggaatattttagaattacagaaagtctgaaatgaatggagacagagagatctggaattctcattttatggatgagaaactaaggtgcagaagggagactgaacatgactaaggtccacatggaagtggaagggagaatagaacttagttgatttgccacctaagctactatacctcccattgttctgtggttccctctaatacccttataggtacgttataaatcataaagattttataaacatagttgtgattgccatgctaaaacacacaaatgttggcattgtgtcatctttcacctaaagcaggatttggcaaacttttctgtaaagatcaagatagttcttactttaggctttgccaatcacatggcgtccatttcaattcctcaacactgtcactgaagccttaaagcagccatagacaatgaacaatcaaatgggcatggctgtgtttcagtgaaatttcatttataaaaacaagctatagaccagatttagcctgtgcatcctagttttgtttttttgacccctgatctagaaaatcagctgtttctctcattttatccaagtaccccagtcctgaggtctgttcttactgaacccagttggtacatttgacacccagtttgtctgagtcagcttgtgctattataacaaaagaccatagactgcgtgcttgaacaacagaaatttattcctcacagttctgggggctggaaaggccaggatagaggtgttgcccaacgtggttcccggagagggctttctttctggtttgcagatggttgccttcttcctgtatcctcacatggtggagagagatgtgttttcttagggcatcaatctcattcacgagggctccaccctcataacctaattacctcctgaaggccccacctccaaatactattgcattagagattaggcttcaacatatgaattttggagggacacattccatccataacgcagtaaatgaccagcacggctttgacattttttccatcaaaataataagaacacactgatgaagttgtttgtggcctttaggagaagctctaagttttctattaaagtgcttttatggaatgaaagttaagacaaggtacaatggctgtgtcctggagtcttgcttagaccagccttcaacatgaccttacacttacctgtttcttctaccctggcagtgcccaagaatttcccacaggaactgaggagttacacggtgcaaggcttccgtgtcattgctcttgcccacaaaaccttaaagatggggaatctttcagaagtcgagcacttagccaggtaagcaattcagaaattggcactagagcaggctctgtgcccatgaagtgcgagtcctggagatgaacagatgaacagttctaatcacctggaaggctctcagagacagagaattaatcttgtacagtcccctgactcagagatggataattgtaggtgatactggagatgacttgctcaagtcacaatgctggttggtggcagaacaaggatggtacttgagagcttctgactccaagataccagtgtgttatctctgcttggcactatgttatgtcaactttagtcgcagctctcatcccatcaaaacaaccaacgctccttcaacctcagagcattatgtgaccaatcaacttgggtggcccatacacagagaggttgagagagggagacagttggcactttgaaagattttgagaatactttagacgtggttttttcagtgctcaatactacaacatctccttcgtatctgtgaaggtaacaagggcaaattgaattacttatgagaaataaaattcagtattcttaattacattacagggataagttgtcctcattagaggataatttataaattattatttctttcaacgttcttcagtttttaaaggctattttcaaattatctatgacaaaggagtaaaaaaatactgtggaaaactgaatagcagaaaatctatttatttcttacattggatttgtgttgctgataaatgctaatttatatacagctagctccttcatgtaaaatagtgatatccttggtttaacattattatttgcaacctaagtccattgactctaagttaattagtaaacacagtcccttccttactctgtgcttgtttcaccatctataaaatatgcaattggatgatctccaagaaggccttcagccatgacattttaatacttgaaacaggatcacaaagcttattttgaaatatatgaatgtcattctcagatttaacattccaggtgttagctattcttgagcaaacataaaggtccagaccacataggatttgtaattttctaaacacaaatttgaataatcaacgttaaggacatgtgtgaagaaaagatctatgtagctagtgatggagtgtagccatcatccagctgtcacatacaaacgcagctgtgttgttctcatgtaagagccactagtgggatagacattataaatataacaaaataagaaaatgaagataaaatgtgctatatttccaaccattccaggtttttttggggaatatcaggaacttattatacttcttagaatttagttactattttcaaacagggtaaaaggatagggttttggtttttcttagaatcaaattctatttagcaaagttttccaactagaaaaatttaaaacttcttaaaaattggagtcataatggggaagtagaaaagttttttgagatgacgtaaaaagtcaccccaaactaaaacagcaggataaatactccatcaaggctcaccccttcaccagtttagcaaatctgtattgaacttaactgtatgtcagacgctcaaggaattgagaacttatttggaagtgaataaaataaaatccttgtcctcatgaatatatcctagttggggaaatagattagaaaataaacccataaaatattatcccactagtggttcttaaatgacctgagggggaaaatataaagtaagttaagaggactttttaaaaaagacagagaatgtcattttgcctaggcaatcagcaaagtcctcagaggagcaacattttaacagacatttaataaaataagagagaaagacacgcagatatccagaggaagagcattgcagggaatagaaatggtgggtacaaaagctttgacacaagcactgctgggagtgttgtagggtaacaagcagccaagtgcctaaagtagtgaacgagaagaagcatcataaaatagaaacaaagaacatttgcctgtttttgcttttgttgcctgtgctttatgtgtcatagccatgaaatcattgccaagaccaatatcaagaagatttctccctatgttttcctctagtagtttcacggtttcaggtcttatgtttaagtgtttaatccattttgagttgatttttacgtatggtataagataagggtccaatttcattcttttgctggtggatattaaactgaaaagttttgcacagcaaaggaaataacagagtgaaatagcaacctataaaatggcagaaaatctctgcaaaccatatatctgataagacattaacatccaaaatgtacagaggacacaattcaataggaaaaatcaataaataatccaatttaaaaatgaacaaaggccctgaatagacatttctccaaagacgtacaaatgaccaacagatatatgaaaaagtgctcaactttactagtcattagggaaatgcaaatcaaaaccacaatgaaataccacctcatacctgtaaggatggctatttgaaacaaaaacaaaagaacaagttgacaaggatatagagaaattagaacctttgtaaaatggtacagctgctatggaaaacaatgtggaggttctttaaaaaattaaaaatagaatgtttttaattttttaaaacattggatcaccaggtgatccaatggtccaaaatcccacttctgagtatatatccaaaagaactgacattgggatctcaaaaaaaggtatcttcacctttatgttcattgcagcattatttataatagtcaagatatggaaacaacctaaatgttcatcattggatgaatggattttaaaaatgtaatatgtacatataatggaatattattaagccttagaaaaggagaaaatcttgccatatgagacaacatgaatgaaactgaaagacatcatgctaagtgaaataaaccagtcacagaaggcctaatactgtgtgatcctacttatctgaagcatctgaaatagacatattcatagaagtagagagtagagactagaattgtgattaccaagggctagggggagggggaaataggaagttgttgttaatggatataaagtttcagttatgcaagatgaatacattctagagaagtgattttaacacacacacacacataaaacagggtagaaggaaactttttgaggtgatggatatgtttattacctggattatggtaatggcttcacagctgcatgcatattgttcagatctatctccctgtaatcttaacaccacggtgcacagcaaaatgaacaaagatcaaaaaagagttcttggcccccaaatttactttttaaaaagccacccaagagtgattccatttcagaggaacgttcctacataactaatgcaacccagttggactataagccatcactttcaaattccgaaaactgttcagagccctgtctgatgccagtaaatattattcaaggcgacagatggaaactaagatgaatgacactgtattcaactactactatcgtgtcttgtatgtatgcagaatgcccttaataaatgccaaataaactgaaacgattgcaagctcaaaaaagacaaagcactgagaaattaaaaaataaagtatatttgattaacatatttaaaaaccaacagaagagttggaagataagcacattgtttttaaaaataaagttggaaactggaaaaaacagatttagaagtggttgcctctaggaaggagaggggtgaggtggtgtggagacagactactggttttcattataagcttttaagttcattttgatttttaaaatgtgcctgtattgcattaataaaacttataaatttttaaaagaagaaataaattgaactatggagcctacgtagatatactttaatattgattttctcctgaatacaaagagaaaaagtggagtcagagttaacatttctgggacttctcatcatggagaatcgcttgaaaaaagaaaccaaactggtcttgaaggaactgagtgaggcccgtatcaggactgtgatgattacaggtatgtatttgtttctaggggcctggcaagttgattgtatcctaggcataagaacaagatgtgtgagctgagtgagttcatgtatcagagacagggaaaaatgttctgttgtcgaatttgttaccctgtagtcccttacctaaaaacatgtgcagctgccccgacaggaccagaagctttgaaggtagggaccgtatctcatcctctttgtctaatgactacccctcccagccaggatctgtgcggtgcctcaaggctcacagtaaatgagcaagaatgggtgtgttctcatcaagaaacccagtgatccctctgcatagaggattgagtctctggttgatggtcctctagggcagtagggccaggcatggtgtatgatcgtcaaacccaagcacagcctgaccctgtgtgttctttgcttagttagtttccagatcccgtggatggtttaagctatcaggctgagatcatgctatattctccactaagagttgtctgtcttctgaggattggtcataaatgcttaagtatttctttattaattcacacatgttttgaaatacacatggaccaggatatgatgcagaatatggagagggagatgggaacatagtgtttgcccagtaggggcagtctacagcagagaggaagataaaataaggcagaaagcggtaaatgctctcaaagaacaccaagcagagtggaaaagggagacctcagttcttgttgctgaggggaggtttgtacatacagcaagcaaagtttctttgtcttctaggtgataaccttcaaacggccattactgttgcaaagaattctgaaatgatccctccaggcagccaagtgatcattgttgaggccgatgaaccagaagaatttgttcctgcctctgtgacctggcagctggtggagaaccaagagactggacctgggaagaaagtgagcaaatgttagaaggcccctccgtgggcctagactgatggaatacagtcctggcactgctcagccttctctcaactccaggagtcatctcagtaataatccctcacatctgtccagagtttgacagtttgcaaagcatttctgccagctctggttgcctaggaaaatcacctgggggagtttctaagcttccagtgcaggctgcaccaattaaatcagaacccctggggtaggaactggcatcaggtgcttttcccagcaattccagtgtgcagtcatggctgagaactactgatttatactcatattttccacttggtcattaaaataaccctatgcaattgggcaaaccattaatttttacagatgagaaaactgaggctcagagcagtaagattgcccaatacaaaaactggtgagttgcagagcaggaaagcagacttaggcctatttgattccacacagatccacgggcatttagattgtactatacctatgacatgaagctaacagaggctgggcttttctagatagaaagctccctatgctcttgtgacagaatagctttttcataagacaatgggctgtagccttacattccatcactaaaggtaacacccatgcttttgtgtgaattcaaagatatggccctacaggtgatgaattacaaaaatgctgccttcctccaggctgaccagcctttcagattgttaagtatagagcgggcctttgtgcagtcaggagtctttctgcagcacacaaactgcacagctatacagaatggccctgcccctaccctgggaagaggtgggttaacttgcctcaacctctaattgcatgggctgtgaaagatgacagctctccctctgctctcagcagatttctggtgcttatttccttgtgaacctacttgcttctccatcggtgcatgctgcctgaatttcactgcatgctgtaacccaggtcctttgtgaattttaactaacagtccactcacactactcattcatgaatttaatgcctctgctgaaattttagtccccaccaggagaagctgtatcacagtttcaggccttcctcctctctgggtccctccaccatacttcctctccccacattcccagtgcaagcaaaaggaattcctgcccttgtctcaggagggatgctttagaacatgtcttttgttggttattttgcaattggagatagaaagggaggggtgtgtcatcttgcctcccaattcagcacagcaatttttttttctttcaactacaatgctttccctgagatgaagtcatctgatgaataaaattttctcacctcctgcaatatttgaatttagagtcctaaacacaaatggaagtctctctgaggaatgttgcatgaaaaaccatgattaattattgatataatgaatgcacaggcattcatcagatgctttctccctaactgggaaccagggagggctagaaccaagccagagaaacaccttgacaggtgcaaggaaggagggaaagggtttcggaaaaggattactcctgcagtgggatgtagagtatggaagagaatctgggaaccatgatagaaagagatacctgttgaggtggggtcataacaaaggtcagaggctggggcctaaaaggagttaggcactgaagaaagagtgcctgctttacagtgaagacaatgagggtgattttggaataagtgaatggtagagatcttagaaaatataaggttgcatgaggaggagaaggaagaagagggaagaattttcctattcttgtaataactatttgggacctaagaatggttggatttcttcagtagactgacatcatacatattatctcccaagacgggatccagagtaccatactgtccaagtatcatatgtttacataatcttggggggaatgttttgagtgttttttcctatgggtagaactgctataggcaaattacacattattttgttgctgaccttcacactgttaggcaacatgaaaactcttccttcaataacgcataggaaagcagagacactccttaggagtcaatgtagaaatgatgcccttttgattttaggaaatctacatgcatactggaaacagttcaacccctcgtggggaaggaggaagctgttaccattttgcaatgagtgggaaatcataccaagtgatatttcagcatttcaacagcttgcttccaaaagtaagtactgaagaaagaagtgttttgttttgctcctcaaatcagcgaggcgaaaggaggaggagagtattgaaaacagtgatcactgaggttgcctcacagttagagaataaacacccccaaaggagtactgctcctgaaaaagttttctggccctttttatgccttctcggtcccaggcagacccacggcctcccgttcagagtttgagttctggtaccttctctcacccctgtggccagttcagccttcctccttctttccctccccacccaggagaacggcagagttccaaacacggtgcttgttttgagggccagcttctctctgaaaccaaccagctcatgtcaggctaagctctattccccttcttgcctggattcttaaattacagcaagaggaaacaaaggccccatggtttattttcagagtcatttgttatcttgtcctctgtgtgtcctgttttaaaatagtgctgtgcagggttgcactgtcaatgtgcgggagattaatggagcacaaggggagggcagcaactatctgttagcagtgtcatgaaaattctgtcaccctagcagtcaaagtccacagaatctagaccccaaaggcttctagaaagctcttagttcagttcagggaaagctgagactcagagatattaatctgcttgtctaaggtgtgcacagctagctggcacagctgagaacagagccttgtttctcagcttccagcctttcctctgtctatgctatgattatggagatggtgtctatcaggaaagaactgtgtttcctcaagcatttttattccatatgctcttctgcttcttagttactgtagtattattgattagtggtcaccccatcttggaaaaatagtctgggaaaaaagtaatggagttgtgatggaggactttaagtgaaatttcaatattaaagtgttaaatctccttatttcccttcctggtattggtctaatgacataccatccaatgctgtattaaattagtaaccaggagtgatttttcagggctgttcttttatttttaaaagttttcttcttcccaatcatattgcaatggttgttttttctttttagattctggtgaatggaacagtttttgcaagaatgtctcctgggcagaaatcaagccttattgaagaatttcagaaattaaagtaggtgtcatggcatgaaagaagagtgtgctcattaactcttgctacctatgggtcaataattcaggtgtgagtcagaatggctattattaaaaagtcaaaaataacaaatgttggcaagattgcagagaaaagggaacacttatacactattggtgggagtgtaaattagttcagccattgtagaaagcagtatgacaattcctcaaagagctaaaacagaactaccatttgaaccagcaaccccaatgctggctatatacctagaggaatataaatcattctaccataaagacacatgcatgtgactgttcactgcagcactattcacaatagcaaagacatagaatcaacctaaatgcccagcaatgacagattggacaaagaaaatgtggtacgtacacaccatggaatacagtgcagtcataaaaaagaatgagattatgacttctgcaggaacacagatggaaatggaggctattatccttagcaaactaatgcaggaacagaaaatcaaatactgtgttctcacttacaagtggaagctaaatgatgagaacacatggacacaaagaagaaaaacacagatattggggtctacttgagagcagagggtgggaggaggaagaggagcagaaaaaataactactgggtactgggcttaattcctgggtgatgaaataatctgtaaaacaaacctccgtgacatgagttccctcgtataacaaatctgcacatgttctccaaacctaaaataaaagtttaaaaaaggggattaaaaaaaaattcaagcactggcttgagtggggaaaaaaatctctcaccagcctcattcacatgttgaatgctcagtgcctcatgagcggttggactgaacctcagtttttcactggctagcggacagaagccaacctcagttccttgtgacaggggccattgcataaggaagctcacagtgcaacagttgacttctaaaagagcaagcaagcaagaagaaccagagacagagcacacaagacggatgttgctgttttttatatgccagtctcatcacccttgccgtattcccttccttaggagtaagccactagatccagcccacgtccaggggagtggattacacagggcgtggatgccaggagctggggatcgctgagggccatttagaagttacctattccagagagcatttgttctgtgggccataaggcatatatcttagagaaccctcccatgcttggatgtagcagaaatagtggggcaggttgtatagcttagaatcagaaaaatggggaagtaggtgcgttataccctggaattattttaggttggtccattagaagatatgtgaataatttctggtcttcttagcaagaggtgaaatagcattttgcctttatctggccccagcagggaaagtcaagagaaagtcctttattacccccttcaaaaataaagatgaccaagttaccttatagtgaaatggtacttcttgagaccagatctacctactggtttctgggaatgtaacagtttggggctgcagagtctaggaagtgaaaaggaacatagggtagtgaatctttagatgatggctggtgagttgttggtgaaatcaggagacacccttttattgttagattttgttacccaagcattcatagggaagtcttacaaactgcctattaacttccagaatgcctgaggctgggtaagtaaccagtgactaaatgactatttcattcacatgatcattacatgatattgctgaagaaagtaattttacctttttcaaatgcctgagaaattttgccaactaaaatgcctaactttgaaaagccatattccccttaaaaaatgaattcaggaagacacacactgcctcagaatgagctgtcttctcaacatcccaatcttcctcctcatgcctttgtcattggcaatgtgcataaggctgtctgcattctctttctgaattcagggaatactagaagatgataagattcttgatgtgatatagagactaaatatgtgctttaagcctgaaagaaggagccatttttcaacaattgtgggtagtcatgacatgaacatatatagcatgattattttcatctacacagcccagtatcggattgaaccataggggtgtgcctacatttgacttttttttgtttttgagacagagtctcgctttgttgcccaggctggagtgcagcggtgcaatatcggctcaccgcagcctccgcttccaaggttcaagcaatccccctgcctcagcctcccaagtagctgagattacaggagcacaccaccatgcccagctgattttttctatctttagtagagatggggtttcactgtgttggctaggctggtctcgaactcctgacctcaagatccgcctgcctcagcctcccaaaatgctgggattacaggtgtgagccaccgtgcctggccacatttaattaactgtttttgacctataaaagtggttgtttcttatgcattaactaataataacgaaacgctaacaaaactttattttttctccttattgatttcataactctgtttttagaaaaatgcagctaagtctttaagaatattgtcatttatcaatacttataatgtataacttataatagaaggcaggcagtgtcttacatctgaaactccttttctttggcagccgtattaatttttactcttctatttgtattgtgcttgcacaccaaactgatatagatggaaaacatatcttattttcaccctgacatgcatcaaaaatatgaatatatgtctctagttatatctgttaaactgtttttgaaatttctcatcctggtatttgagctgtaaatgctcagcaacagtcagtgactaaaatgcagctggattgggttatgatctctgcattaggttgtgtgggaagtgctctgctcatgactgcatactcttaagcttggccttggtgcgtatcatcaagcaggacttcttttaaagtgtgcaatcactgttttgccgatgtccttggttatatcactaccatttcaatgtgattgattgaaacaacttaaataacgcaactgccttttccctctgggaatatgtctctccaaaccatttttcttcagcctgattccaggtgtgttcaggggacacacacatacacacaaatcacatgtgacttagttatgatggaaaatattcaagtgagctgttcatttttcttacctattaatccttcttctcctgtctcccgcagttattatgtgggcatgtgtggagatggagctaacgactgtggggtgagtagaaatggcttttgctcagacaagccactcactaatatccctctggaggacctcaggctctcctggggtttgtctcttcatccttccaccagcaaccatttgattattttgctgtttatatccacctctacctgagtgtgggttggaagcggaggggagtaaagggagatgagacacttccgatgctttctggaaactcctagaataataaacacaaaggaaggctacttagactcccatatttcaggttccaaagatggaactttacaagtctatctgctttaaatctttcctgttatcagtaatgaaatgatttctcaaggaggtgatttcttcccccctcccaaggtcacacaactgataaagactcaatgaaacgaagtttgaaactgatgattaaagttttgaattatatgtaaattatatttattcctgccaaactttcattctctggttagtttttaagtttgcttcacccagaactctttcactcagtaaaatcctagaccaaactatttagttattttatgctatagaaaaagctaaataaaatgattatcagcaaattatttttcatatgcagtagaagggcagtgaatgttttatattctgagttttaaagacatgaaggaaacaaatagtctaccttcaagattatgtacttaaggaaatatttcagtagctgatttatgggacaagaagtgaggaagatttctttgtatttccaaagcttattagagatttaagatcttggtatttgttttatttctctcttaaatattatttccaaatttctgtgaaaactgtgtttatagctagaaatttttatagctagagatgttttttgctttatgtttcatgagaaaaagctaatttttagtctgttctttcaaatctagaatacgtatcctctcacattaattatgtggcgtttagaataaaacaaaaaaatcaaatgcaaaaagggacatagtctctgcctcctaaagagttcattgtctgatgaagaaagaatcatgaataaaactaaccctaacataaagtagatggtcctaaagtacataatagagatacgaactagagatcaaagaggaagaagaaaatgtcctattatttattaaacctgaatctagtatgtactcatggcgccaggtactctgtagttctgtggaactacagatatataaaagttcattttatgcccacacaattcttataggatcggcctaggaattctttcacctttgttcatgaagattcccaccaggtacaagaactgaaacggtgaaggtccccaaccaacgtccatccaaattctgtcatctttttaattgagtttttgaatgagggcttccatctccttttcacatctataatccccacaggcagggcccttgtatgcacatgcccacatgcacacacgcatgcatgtacacacaccacttttctacctctgggtcattgtttagttagtgactttgtggatcaggggagagagggcactccaggtggagggacagcattaaacagagacccaaagatgaaacagtacagtgttatacctttatgatgtgaagaacagcctcttggtgttttaagaggtaaagcctaacctgaaaagtcatgggtgagacatgggcttatcattccaggctttgaaagcggctcatgcaggcatttcattatcagagcaggaagcatctgtggcatccccttttacctctaaaacaaccaacatccagtgtgtgcctcatctcatcaggtaagtcattttttcctcttccagccctacaatcaatgggcccattgtctggctctgcagacagaattcaactacaagctaaagtgataaatgctgcaacagaggaatgggtgaagtgctattggagaaccaatgaagggggccattagtgttactcaagagtgctggtaaaagccacagaaaagtgacttttgctgagccttaaaggataggtgggtatcatgtaaacagttgaaagcttgacttgatgttttaaaactaattgtatttcttactttttctctcctctatttggtatgttggatgcttcctgtaacatttctctcaggaattttggatggatgaggaagcagaaaggaaatacttcattagatagcttccctaaatactattacatgtctccaaaatgcaaattagtaaatatccaatatcttttacataaaaagttgattgacagtgtcagggaaggggaagtgatatggtttggctttgtgttcccacccaaatctcatctggagttgtggttcccagcctgttgactggatcatgggggcagtttccccgatgctgttctcatgatagtgagggagttctcatgagatgtgatgaattttaaagtggcagtttcccctgcgtgcttcctctctcttgtcttgtgaagaaggtgcccacttctccttcaccttcgccatctttgtaagtttcctgaggcttccccagccatgtggaattgtaagtcaattaaacctcttttgtttacaaattaccctgtctcaggtagtaatctttatggcagtgtgaaaatggactaatacaggaagccattaacagacgtttattttcacagcatgcttccctcccctccactccactctgatttctgatctcatgtctacttatattttaaatgtagttaagaacaaaacacccagttttatgttttattcataaatctgatttatctattgtttcctatagcacttatggataatttctgggcattttcatgggcagtgatctgaaaaccatcaccagattttgagattcatacaaaaaagacagccatgaagttccccagcatgtcctttggtgcatcagaataaacaggtcactggcaggaatcactgacctaaaggtagcaggtctaaaattccacacccctggttggctgcatatcagcaagacagctttacacaacaccctgaacactgggtgtctgcacgtgtgtcctttcacaccctcaaacacgatcacttcccctgcctccaaagcagctcctcttcccaactcccactttccttgcttctaagaacagtctactccttggagtctgccattgaggttcagacccttagagtgcgtgtaactccttcctcttcttcacccataaccaaacaagcattatgttttactgatttattttgcagagtatctctaagccctttggttactatctctagtgtcttaaccttggtttgtgtcatggtgactacatgatgatagtactcagaaccctcgccttattttatgctttccattgtcaatacaactcatggagctctttacaagtgtgcttggaaatgtaaagaatgagagagtcttgcccccggagaatttacattccagcaaaaattatgtgtgtgtgtgtgtgtgtgtgtatgtgtatgtatatgtgtaacatgttacatatatttacataaatacatatatacatatatatgaatgtatatataaatatgtgtgtgtgtgtatatatatttatatacacacacacatacaaatgaagtggatgtgggtcacttcccatgtggattgcttctgccctgaccagaggaggctgaaggagagctggtttgctgaggtcccactctcgcatcacgtgctgctacctcacgtcttcttttaacctgtcataatccaccattcagaaaacctgttaccgcattaacagctaagactgaatttttttaaaggagaaatatctcctttacatatatacatatatacatacattaacatatatacacacacatacacacaaatatatacattatttattgagtgtctctcatgcatcaggcatgttttatacacacacatacacacacaaaattatatatatacaatgtctgatacatgggacgtgctcaataaatttgcttgaaataaattaatgtccaaacaagacagcaaatgttctggcagttgagtgtgagaactcaagccaggagggaagctttcagtaggggagttgcaacttgaaaaatgggtgagacttatgtaaacagaaaggaggtgagaaggaattccaggtggggaaaatgcggcagccatgtttagacacagtgttgtaactggagaatgcaggggccagttggtgcaactgggctagaagacttctcagatgagaattgtggtggttaagctagacaaccagatgtggagaccttgcagggagtttgagctcctggataacagtgcaaagtgcctacttgatccattcaacatgcagtggcattcgaacttcagatgctcctcctcatgcatgtggcccagtgcatttatgagtgcagtgtactgttacggaatacaagtcatgatgtaaaatttctccagtggcagatggctcagtaagacgctagggtagaaactccttgcttttatatttcatagactcataaaaattagatatggttcagctctgttaggctcattttactttttctatccttgatgcatacttattcctgagaaagcactccagagaggcaatgagatacagttttagatgcataggatcaaatccacggattttcatctttgtcttttgaaacatgatttacttgttgctatagttcaagtcctttagggcagagactgtgtcttagtgatttttgtatcaagcattatgcctagcactatgctgggtatatcagagcattcagtgaacgtttgtagaatgcgtagataaatgcatgagctacttaaaattcacaatcattaggaatagcagtaattttggaggcccatttatcctttacttagaatagtttcttgtactttcctttgaatctgggtgtcttaattttcctggaactatgcacgattgcagaaaaaaacaatgaaatcgcaatgtttatatcagacttgggaaaacgatccatacttcacatgcttgccccttctcagcttgtcttctgctccatcctcagtgttgaaaacaaacgacagcacctcacagcttggtagaaaatatcttcccaaaatatcctggcctctctcccacccttgccttctcattttgcctgagacaaagtggttagtagtttggcttttaggttcttcttttcatgtccctgttctgttgaccacatctttgagcagagcaggtgtccatgttactggggagtagaaatgaagtggatgtgggtcacgtcccatgtggattgcttctgccctgagcagaggaggctgaaggagagctggtttgctgaggtcccactctcgcatcacatgctgctacctcacatttttttcttctaacctgtcataatccaccattcagaaaacctgttactgcgttaatagctaagaccgaatttttttaaaggagaaatatctactttttaagctgcattttttactgtcgtcttgatctcttgatctttatggcccactcagattattaccctggggtcttcctgcaatatcaaagccttccttacccatttaatctcaaatattagagtcacattcacacttcctaaaatgtcaaagcacctatcctttagctttatgtctccaaggacctctaaagcacacacaatgcaattcccaggaagcatgtattgttaagatgtaatgagtcacaagtgagtcaatgcttgacattttgcaccttatcataatgttgtattgtgtttataatacacatagtaatcttctcacttcactgaaagcttgttgaaaatgaggagtgtgcctgattcattttatatcctctatgactcttagcataatgctggtacttcataagccctaaataaaagtgagtaaatgaaccgatgagtaaggtaatgattgaaggagagaatgaatgaatgagtggttaaataaataggaggatgaattcatgattaagtgaatgtatgtcaacaggctactaaaaatataactcgttttaagtataaaagaagttgggagacatttatcatacataaccaatttttatttttatttctttttaaacagagaaggccgagctgctctggtttcatcctttggagtatttaaatacttgaccatgtacggcataatccagtttatcagtgcattactgctctattgggtatgaaacaaaatcattttgtctcagttctaattgcatttatgtccctaatttattattcagggtgtagctcctatacaagatttaatgttttataaacaaatgacatttctcaaaataggtgtctgcaaactcaggaacctggtgtaactgtgcatgaaatgtggaactagaaataagtacatgtagatgagttttctagtgtgttgtttttctcttgataacctgagactcttcacctctccaaacccctgtttcttcttttggaatatgaagagagcttcaaagcagcctaagtataattcagcaggaaatggatgagtctccaattgtggaatattttcaacggaagactaagaagagataaaaaggaagagaagctgttgaatttgcttttgaaggactagaatgctaaagacctttcacaatggacccttattcctgaaggtacctagaatttatacagtcagggatatcattagtaaagaatcggaaattctttgaaactaaaaaagactcaaaattaaatgatgaaaatagccatttaaaaattaattagctgtacagaagaactatgtataagctaaaaataatcttcattagtccaaccatagcttgtactacagtaaaatgatccaacaggctcaaggaacacttcaggagggattattctattgctttcctgggaggtttgagaagtgaataagagggccacaagattataccatccagtgggctattgcttgcaagaatcacacacagagggctcaaaggcagcctggtgggaagaaacaagaactggactgggagtcagaaaacctggattcaagttcttcatccaaaagaacaaattaggtcttgcctttggccaaaacctgcttctgggaagctgatttttcagagccctccatagttccatgaaagcttctcctagaagaaaaactaaagctgcggttggaaatttcttcctgctccatctcattctgaatatataattttaccactctcaggtgaaaagaagaggaaaggatatgagaaagaaaagtaaagaagacaggaagaattggaggttgacagggacactgaggaaccaatggcagcctttcaaacatgtgaaagcagaaattcattttccaaagcctccacggatggaggtagaaaccatagtccactctgcagccattcattctagtggtctagacctaaataagagtgtcgcagaagaaccttaacctggtaccttctgggacttggattcactctctgagaagccagcaatactttccatgtgcataaatctggtctgtaatgtgctcagaaccagtttatagtttagtgcttagtcgacagatatgaaacagataaacagacctggctgcaagagatattgcaaggcaacttcctggagagtaatgatttgactttcatatctaaatacttcaactctataatgtgaacttgaaagaagttctgtctacacaaaccttaaaaaggcagatgtacccgactgaattctgcaatgggcttacttagggtaggagcctttgttcagtttgtgaaagtgaatggactccaagagacctatgttgtaaactcataccatgggtgaggatggagagcaatgcctattgaatgaattgcgccttcacttcaaattttaagtataacatttctaagggaacattcaggctttaacatcttatgttgagaattcaactgcctaggctgagactacagctgtcaggtaattaatgcacccaataggagggtggttctcaaataattgacttttgtcgctaatatgaagtaggttaaatgcagggaaaatagtcgtctggcctcattctacaaaatgagatgctaataattttaggttagtcattttcttcctgaagagggaaaaaaaagtaacagctgcctcctaacgacttaaaaagagtgtagggaataataaataggctatgatggcagatgccacatttatatttgcttttgtttctttttcagcaactacaactctttggaaattaccagtatctcatgcaagatgtagccattactttgatggtctgtttaacaagtaagctctttagcaaagaaaactatattgtttttatttatctatgaaattctagaaacagtcacacaaaaaggaacttttgagaaagaggcacccttatttccaaaacctcattatttacaattttttaaaagtgatattgggagtaagttgagagttgaaatcctgagacttggcattaaaacattctgacaacaaataggtcttagtcacaaaaaactgtcaacgtagtccaagttctttgtagttttatgtcttgtacatagaaaaatgaatacaaaacctagaaagggaattttttaaaacccaaaggtcactttccattattcagctatgcttcacattgacgtgaaaccagatttttttctaggtctttgatgtgtgagaacaaatgctaacattttattttagtagaattctccaaaagcaaggtgtggcttccaacagcagctattgctcatgtccttcctttgagatgacactggtaaagtatttcctatcaaggagctcaggacttgatgctgactcttaataagtgataaaggtgactgcctcaccagagagcaaggaaaaagaatggcattgtcatctctttttccttgctcaacaataggcatgttatgaaaaataacagataaaacatcaggcaatgtaggatattaataaccttgagaatttcatgtagcaccttagtacataaaactgatatgttttatgtatcaacccaatgactgaatttatcagtatcagagctataagcactaaaacatcaattttgattcttagggttgaaatgtctattcatagttcattaaaatatttttctacatgttattaatattcatatgactgaataattttgaatcaatgaaattgcttctacagcactggatattttaagcaatttgcatgatttatttgtgaatgatactaaaaagagaaaaaaaacaccaagaggtttcaagaaccaagctttcaggcagcagcatggaggtgaaggccatggctattgtggcctgttttcgtgacctctggctaactgtcctcatagaattgtgaggatcagatacaatgatgctggtgaagtgtgcatcacagcacaggacacactgagcactcattacaacatgaatcatatctcctccttttcctcttttgagaagactgactagctctctgagcacttgaagagccttagaatgtgtacagatagaccagtgtcattagaaatccaaaaacatggatgatcttcctagttctagtcttgcctccgacttactatatgacactgagcaagttatttggagcttttgcacacttaattccatgatattagttatgtggtaatggggctgcttaaatctttcccacagcaatagcctgttgagcctcatgccagttggtagccctgggaaactcagtctcgcatctcagaatgggctctatgggagtgctgggatgactcacagtgggaccgttattaccactaggagaaaaaaaacctcagaagggtgacgatagaccagaagcataacattctatcagagtgacggcactttaattattactcagcagactgtagctagtaaatgggctaaactcagggagattggtgaaggagagagtagaggcagaaaccagctatgtttgttagtttgttttttaccctctacctgcaaacatcctattgttttcccgtctctgcaaacttactcatcccacaggctagtcatttcctggtcaagtctaggtattaagatgatcttatccttagacatgaaaagtccaggtattataattattacttcacattttcatctgattcaaagcttttcttcccttacattaagcctgaactatgggcttggggcaagcagtagacgagaaggccatggtctcttcttcacttcccttgagtcacctactctccacccctgtttctggggaagaagagcaacaagaagaaaggacttatttttatgatttttgtgttcttttttctgctgcaaattttaagttccagggtacatgtgcaggatgtgcaggtttgtcacataggtaaacatgtgccatagtggtttgctgcacagttcaacccatcacctaggtattaagcccagcatccattagctattcttcctgatgctctccttcctccttgcccttcccaacaggccccagcgtgttttgtctcccactatgtgtccatgtgttcccactgttcagctccacttataagtgagaatatgcagtgcttggttttctgttcttgcattagtttgctgaggaacaaatggaaaaacactccatgctcatggataggaagaatcaatatcatgaaaatggccatactgcccaaagtaatttacagattcaatactattcccattaaactaccattaatattcttcacagaattagaagaaactattttaaaattcatatgaaacaaaaaaaaagagcacgaatagccaagacaatcataagcaaaaagaacaaagctggaggcatcatgctacctgacttcaaactatactacaaagcaacagtaaccaaaacagcatggtactgatacaaaaacagacacagagaccagtggaacagaatagagaactcagaaataagaccgcacatgtacaaccatctgatctctgacaaacctgacaaaaacaagcaacggggaaaggattccctatttaataagtggtgctgggagaactggctagccatatgcagaaaattgaaactggaccccttccttacaccttacacaaaaatatcctgtcaaatgccctcaaacatggcaacacccacatttaggcaataggcacggggttcattggtgaattcatcagagcttccctgtggataggtatggactagaccacaccctgacatagtggtgctctctccctctgacttctcaggattcctttctgcagctgcctcctagtggtacataccatgaagcccttttctactactgggccctccaacccccagcaggctgccacattcataaactccttccaggatagctagctctagcctggctaatttccatggcttctacttaacctaccagacagtaaatagcttgctctcgctgctgcctgccctttccctctgctattaccatgaaggggagtgagcaaggccaatatcctctcttaaaaccacttccagtctctctaacagtggctcttatgacttcccctcatggggttgtggtgatgctgagaagaaaaccagtttacattgctcctaacaattgcctttaaagaattgcttgataatctccataagttttatcttgtacagacagcatgcagcgaatgaggcaggaacagacatgcttatagttaaataaccaatatggatctctcttgctagacactatggagatatggcgataatctctcttcacaataaattggcacttgcaattcactgtcctcacatataaggctcggcacaattttctagacaagagaagcaccattcaacattcccttatacaagtgttcatctctcactgtatattagccacgtaggttcctgaggcatgagaaggctgattgttcaagttcagagttcagtgggggattcacatacatgaacaaataagatgcaagttgaaagtagtgagtagcagaaaacagcagatgctttgggagtccagaggaagaagagatggcttccgataatctggggttaaggaggagatagcagtggagaaaggagaaagatactaggcatggaggcatgaaagcagtagcattcacatcaaaataggaaagttggataagtttcaaatatcttttgctaaaagaagagcatttcaagtagaaggaagcagcatgagcaagagaaagctgataaatatggggtatgagcttttaatgtgaccacactgcagcgtatgtgaaatcttttattgaaaaattgaaaaagtgaattgggtcaaatcacagagaatcttgactgctggtctgagaactgtggacatttatctgcagcccttaggagtcatcaacaattgatgatcaatgtaaaattacagatgtccccgatttatgatggtttgacttatggtttttgactttacaatggtgcgaaagtgatgcatattcagaagaaagtggcatgatactctcttaggatgctgggcagtggcagcacgctgcagctctcagccagccaagcaataatgaggttaaacaacagacactttacattgtactgtgttgctagatgattttgttcaattgtagcctacttaagcgttgtgagcatgtttgagctaggctaggctaaactatggtattcggtaagttaggtgtacagcataaatgtattttcaactgaaaaatgttttcaatttacaatgggcttatcagaatgtaaccccattgtaaatcaaagagtatctgtattctcattacggcttcttacatttccaggtttccaggttaaggcttttggccttaactctgacttggttctgggaagagacaataccatcacatatttgatttatttacttatttatctatacacaccctgccttgttcccacaaggttttaaggcaatgtacagagacaaaatataatacattacagagaaaatctaaaagagaaataagatgaagtgaggagggatgttgatcaggcaatgcatgtctggaagtccaatttgactctattttgtgtagcggcatttttaaggagcttgttttgccacatctctgtcctcttcaacaagaactcctcaaactagatcaagaaaatagagggagggtttgtttaagaacataattctcaaaaaaatctaagaacaggaacttggaagcacctggatctgaggatgactagaacactaaaggataaaaatggaggtcactttctttatttccaggtggccaccttgtgtctcttcttctttccattcttactgtttccatctgtcttccatttattcaccctacagctgacctcataaaatgacactaggactggggctttgcagcctttatgtttgttttcttatagctaatgagctcagcctttcattgtcctatttgcaaatattttgaagagaaaatttatcgacctgacgtgggttagatgcccacctctaggcccctcatttctctgaatgaaggtgggatcgtgaaattcagatccatttaggccagccattccagcccctaggagaaggcagtatccagagaaggaggtgcaggagggactcacccattatagaagtgcatctcgtacaccccatctgtgtttcaatgactcctaatcttttctgggtcttggtccccttaaataatctgatggaaaatacaaaccatttcatcttagaaatctcatgatacccatttgaaattctgcatgtagtttaggtgggttcatgaacctcctgaaatttgtcttatatgattttcagtgtttggaataaaaagtaaaccaactacttaggagaaacacaactacgagatagccaaatgatgccaaataattaaaaactataagaatagaatttgaaactgcgaagtcttcccatgcaatagatcctgtgctgggtttagtaagaaacagaatgtggaatgagacaggatttcttccttcagggagctcacagtctgctgagtgcagatgtaaacaactagatttaatgcaagacaccctgcactatagcagcaatgtgagtaatgtgttgtgggaactcagaagggagaatgattaattttgaataccatataacacttcagaagttagtattcctctgaatgcaatctgatagcatatatcatcatcattttaaggaaacccagataatgcagaaaagttttatggggggatcctcataaatggtactactgtccaagcttgtattgcagggcttgccattttgttcttttaatttttgagatgcatcatactgcaatatgctgtagagtggagaacatagggcttcacaatcagaaatactggggtttccagtgccatgctgtcactcactaactgtgggtctttaagcaaaggaaactacttttctgagcctcagtttcttcacctgtaaaatttacctactttgctttcaaggaaataaaaatcatgtttataaacacttattagagcctctggaacctaacagatgtcctacaatggtagctataaaattattttatttataatcaggtatacagattctctgtcagaagtagtaagagtctctaacatggaaaaagtcagaatattctgcataagaaccctgtatgcattaggtattgcctcaataatgctgcataacaacccacccccaaaactcagcatttataccatcaggcagttattctccccattcatgggtttgtaagttgattgtcatttagctgatctaggtcagctcagctgagccagtccgctctagtatgtagatcagttgatcttggttaatgcttttggatttgattcaggtctactccacatttttcattctgaggccaggttgaacggacagatttggtattttctcattgtgagtcacaaaaagcagagccacagggcaagcccggctgtgcaagcatgcttgaagtctatgctaacatctctttggccagagaaagtcacacagggaagcccaaaattaagggatgacaaaatacaccccaccactctgaagccagcaattcagtctaccacagttactgtgtaaaagaaaggcaagaaactacaatgagcatgagagagaagaccaaagaggtagaagccagatgcacagagaagcaattttactctctccactacctgcagcctctttatgaatttatagctacattctgctttggatactggaatacagagagaactccaagcactaaagcctctgccttctgtgacctgaaagcacaatttccttgcacttctcctgagccctgatcacagtccacactgtgtaccccttcttcgtggacccaagcaatggcttctgacaccaaccacccagaattaggccaaactttacagattaagggtaaagcctccacaagaatgccctcacttcagacaccagccacaggtgtggggctctcgataccacctgaacttctgattagttggctacaaacttaggagttcccattactcccttgggttcaacaatttgctacaatttacagaactcaggaaagtgttatacttatgattgcagttttattatagcaaaaagacaaaaatcagaaccagccaaaggaagagacacctagggtaaggtctattaggggtctcaaacaagagagacacttccattgtcctttccctgtgaagtcaggatgcctcaccctcttggcacatcgatgggtgacaatatgcagagtactaccaaccagggaagctcaactgagcttcggtgtctggagtttttattagggtttcattatgtagacatgattgattgaatcattggctgtgaggtcaaacttagtctctaaccccactcccctatctggaggtcaggctgatatcctgtggatcaaagttccaaccctctaatcacagatggtcttttgggcgttggcaggacccttcctgagtcatcttaacacaaacgctcctcattcccaccatgagtcatcttgttagcataaactctcaaagcccaccgtgcataagaaaaatactcctatcactgagggcatttcaaagatttagaggatacatcccaggaaaagccagccagcttctttattacacaatctgtctgtgtctttcatggacttcaaactctttgaaggcaggtggaatgtccttctcatctctgcataccccacagactctagcccagcaccctgccgggaaaacattgattgatctggtataggtaaagacttagtcatagagctttagaataaaagagttgaaagggcctttgggtaccatttaggcattccaacacattttatatgtgagaaaatgaaggaccaaggagtttacatgattaccccagaacacatattgaacaaagcaaagaaatactatagagttttatcatcccacattggacactcatttaccactactctacctgtacactcataaatacaaacttaaatatgcacaccccacttcttcccttacatcaaacaaaccagtgataagctgtgagaagggaagaggtgacaggtatgaagacaggaactgaaacatgactacaatatcagtctttaaattcaaattcctgtcctcctcatgcttccttcctgctctgccttgagaagcaaatacatttcattttcatcagcatgttcatatatgtagctactaaggatgtagtcgtctttttaaaatagttgttctttttaatttctgcccatttccaaacgctttaaatttaaaaaagccctgaaatcaaaaatacaatatagtttaacactctcatctagaagcaatatttttcatgagttctttttcttaatgtaacatacatcagcagtcccccattcacctgtgtatccagagagatacttaatgcatctctagcatctatcacagtgcctggctcattgacatgctcagagaaagttggctgaatgaataatagagtgagtgttttttttaaattatccagcatatgaagatgaatctggctatattcctccttattctcctcattctaactctccactttcctgtcatcactgagacacaatattagtgttgcttatcccacgagcaaggccatttccctcttttacacacaatttctggtcagtctggttatggaggaaatagttgcaccatgcgatatggtaaatatattaattacaaaacttcctaacccacttttttatttctgaaggtgaagacagagcatggaagagacaaaggctggtggaactggatgtgccaccaggcaatgtgcttacctaggtgtaaatcttctgttcgtgtttgcttagtctgaatcccaatgccagactcaagataatatgcatctcaatctcaaccttttattctcaatgataagattgtaataggaaaaaaatgtatttgtctttcagtgagttcaactcatgcctacccaaagctggctccatatagaccagcaggacagctcctttctccccctttactgctttcaatatttttgaattcctgtttctcctgcattgtgcagatcagtgcatttctctatgtgaagcagcagccttggtattgtgaggtctaccaatacaggtaagttcattttcttagtgctgctttcgaaaggtaatttaataaatatccaatgacattgcataacttggcttgaacatatatcctaaaacttttaattaatcaaattgtgtcgctgcaaaactcaaatgatgggacagaacacagttaatccatggactactggggtggagtgggtgggaagagatctgtcacactggttgttaatgtatagatctaacaactggttggctgaatgaatatattccctggtattctgtttattttatagaccaggggttggcaaacatttcttagagggccggatagtaaataggctttgtgcactacatggcctcagttgcagctagtcaactccactgttgcagcacaaaagcagccttagacaataggtaaacaagtgggtgtggctgtattctaataaaacattatctacaaaatcaggtgatgaatcagatttggcctgtgggctgtagtttgcaggccactgatatagacatatgagagagatttgtttattttgttttttcccaaatgaatgttaaagttaaaatgtgaattgatggtatccttgttctgattgaattggactagaatcaggacaagtctctttacctccctgggctttaatgtttttgtggtaggctatagcgccgatggctcaagctttattttgctgacaaagtctttctgccgataaaagaaaaggcaggaaaagagctgctctctttgaaatagcaaatgtgcaaactgcccctcactccacagagcaccagaaatcagtaaaacagattgaaaactagcaaatgatcagattgtcatttagataaaaaatttggcaatttaagtataactaggaatatagaatctcattctgtttaaacactagattttttccaaaattggagtgcatatactcagagaactcaagttttgactgaacctagaagacaatatgttgtagccaaaagaggatggataggaaatcaggaattctaagaattcctgactctatcactaactagatgtgccatactagccctcaattttattaccttaatgtaagtatattggactagatactctttggttgtaaactctataattcaggccatctagtctgtctgttcctctttttgtaaaaatgctttgtgactatggaacatctactacaggcctacgtcagagatattgtgggtttggctccagtctaccacgataaagtgaatattgcaataaagcaagtcacatgaagttttgggttcccagtccatataaaagttatgtttacactatactgtagtctatcaagtgtgcaatagcattatgtctaaaaaagtacatgccttaatttcaaaataatttattgctaaaaaattctaatgatcatctgagccttcagcaagtcataatctttttgctggtagagagcctttacctcaagctgagcggctgctgactgatcaaggtagtggttgttgaaggttggggtatagctgtgacaatttcttaaaataaacaacgatgaagtttgcctcactgattgactcttcctttcatgagatatttctctgtagcaagtgaggctgtttaatagcattttatcccatctcagtactttcaaatttgaagtgaattctcgcaaaccctgctgatgctttgtcaagtaagtttatataatattctaaatactttgttttcatttcaacaatgcttacaacatcttcaccaggagcagattccatctcaagaaaccactttctgtgctcatccatatgaagcaactcttcatccattcaaattttatcatgagattgcagcaattcagtcacatcttcaggctccacttctaattccagttctcttgctatttccaccatatctacagttacatcctccacctaagtcttgaaccccaaaaagtcattcaagaaggttgaatcaacttcttccaaacttccattaatgttgatgtttttaccttctcccatgaatcatgaatgttattaatgacatctagaatggtgaattctttccagaaggttttcaattttctttgcccagatccaataaatgaatcactctctatggcagctatagtcttaaaaagtgtatttcttaaaaaataagacttgaaatttgaaattactctttgatccatgggctacagaatagatgtgtattagcaggcacgaaaacattaatttccttatacatctccatcagtgctcttgaagggtgaccaggggcactgtcaataaagagtaatattttgaaaggaatcttttttttctgagcagtaggtctgaacagtgggcttgaaatattcagtaaaccatgctgtaaacagacgtgctgtcatccatgctttgttgttccatttctagagcacaggcaaagtagagttagcataatccttaaaggccctaggattttcagaagagcaaatgagcattggcatcaacttaaagtcaccagctgcgttagcccctaataagagagacagcctctcctttggagccttgaatccagttattgacttatctctagttattaaagtcctagaagacatcttcttccaatagaagaggctgtttcatttccactgagagctgtttagtgtagacaccttcattaattgtcttagttaaatcttctggaccacttgctgcagctgctacatcaagacttgctgttttaccttgtacttttacatatggagacaccttctttctctcagtcttaggaaccaacctcttgctagtttcaaacttttcctctgcagcttcctcacctctttcagccttcaaagaattgaagggagttagggccttgctctggattagactttggcttaaaggaatgttgtgactggtttgatccactacccagaccactaaaattttcttcatatcagcaataagaccattttacttccttattgttcatgtgttcactggaataacacttttaattttcttcaagaactcctactttgcattcacagcttggctaactggtgcaagaggcctagcttttggcctgtcttggattttgacatgccttcctcactaagcttacccatttctagttttttatttaaagagagagacacgtgactcttcctttcacttgaacacttagaggccactgtggggttattaattgaacagatttcgatattattgtctctcaaggaatagggaggccccaggagaggaagagagatgcggaaacagccagtcagtgaagcagtcagacacagacaatatttatcgattaaatttgcattcttataaaagcacagttcgtggcatctcaaaacaattatgatagaaacgccaaagatcactgatcacagatcacaataatagaggtagtaattatttcgaaaagtttaaaacattgcaagaattaccaaaatgtgacacagagacaaagtgagcacatactattaaaaaatggtgccaatagacttgctagatgcaaggttgccacaaacattcaatttgtagaaaaatgcaatatctgggaagcaaaataaagtgaaacataataaagcaaagtgtgcctgtatgtgcaaaaagcatttctagactacagggagcccaggataataagtattaagtcttgcatttgagttcacgttagaaaatgaatcttatttataaacagttgtaatagtggtttaaaagtttcaagctgaacaagaaagctggtggaaactaatttgtaggtttaattattgaaaaaaaagaacattggaaatagatcaatcaggactgggaaagctcatatcttggacaaagattttttgagtaaatattatgtgacctcactttgctaggtgccaaaaatttattgtaaatctaactaaaaccaaaaaacaaaaccacaaaaaaatcccatattctaggaactctcatcccaaagatgtaaaataaaattatgtaaataaagaattgcaaaacaatgagcttgctatgtgttattgcctttaaccgagataacatttttttaaatgtctttacttttgtgggcactagtaccacttgccagcaaaagtaaaggcatttcagatgcagaggtgtttgaaggacggatgttatatcgcagttaaaggcaatagcacatgcaacccaacaggtatgcaaattgatacgtggggaacagggaataatcctatatgtttggagtgtatagagcatgggaggagtggcaaaaggtaagactgaaaaggtagattgagacaaggatgcaaagatctcataggccagttggagaagtttgagcttaatttatcagcaaaatagagccgtagaccccttataagcagcagactgtcatgttcagattttcaggaagatcctttagctatctgagggaagtaaataggagtggcagactcaaactcaaaactcaagttaggagtcttgtttagtccacgaaagagaaaaccacacacacacagtttaattgacatggtctatttactctttgaattgataggaattcataaaatattgtcatccaggccctttcaaggtagatcacttgttctaaacggagtgccagacaaagaacaatcttgacttccttttatttctgctttgtcatagcaagaggtgaacaaagtatgtcttggtagttactggctgacatagtttgaaagctaaaatcccatggtagtgattaaattattttttttttcacctaatggacaaaaatggaatcaaatgtttcataaacactggtgattcttttgtagtgagtgttttctggccaaccaaagtaatttttcaacaaatgtgagtttggaaagaaactggactggaaatgcaactctgattcctggttcaattttaagttttgagaccaccacactgtggcccatcaccaccatcaactatatcacagtagcattcatcttttctaagggaaagccatttcgaaaacccatctatacaaactgtaagtatataaagtttaatttttctttctgaatattttcccattccctttctcaccctagagttgtacctcactggtgaaatgatgggctgaggaagaaacaattgcatgactctaaaattgttgttgaatgcagtggtcatcgttggtagagcccacatgcagaaaatctgcttgtttgcagataagcacagacattatttaactgtcacatgagtcttgtcctattgtgagtcatcaagaatcattttaaacacatacatgcatgtgaagatattttattaaaggctttctaaccaattcaaatgcaaattaacctctttagccttataacattgggcaagttactttaaccattctatgaccttatttcctcatcggtagaatgggagggagtatccttaatttgttaagtcctgagggaaggactaaacaaagcattttatggaatgggcctagcacaatttatgtaaagggtctggcacttataataggggctcaaaaaatcttacttactttccctgtgtattaatttaagtagagttttttaaaaactcttcaaagctacaattaaggtcctcccagctaaggctgggagtggtggctcactcctgtaatcccagcactttgggaggctgaggtggaaggatcacttgagttcaggagtttgagactagcctgggcaacacagtgagaccttgtctctaaaaaaacacttttacaaattagctgggcatggtggctcttgcctatagtctcagctacttggggaggctgaggtgagaggattgcttgagcctgggaggtcgaggctgcagtgagccaggatcacaccactacactccagcctgggcaacagagcaaggctctgtctcaaaaaataataataataataataataataatccgcaggccaaagaagccagagaatatgccccatcattactgatcagactgggacactctttaggagtgaagtgagacactattaataattatgccaggcttaaatagagaatgtcaaggcaaactagatacatgatacctatccagatattgcatgataaagatggtcaccctatcaagcaattggcttcagtatgataaataatgctataaaagtatacttgtgtaaattactttgacttagcctcttatttccttaggataagaaaattcagttaactggtaaaatagtgtgaaaatgtcaaagcctggaatacacaatttaaagttgctttctagaaagtttgtactgattttcacttctatcagttgttttggagagggtgtgcttcttaatattatatccaacaggaagtactagttaaaaaacaaaatttgtgctggtctgataagattttagaaaacagtgtcttatttggttttagtttgcatttctttgatcaccagtgaggagaaacgtattttcatgtcattagcaatttcttcttctgtgaattgtgtgtttacatttttaaacttattttttttctgttggattgctgtttctcatttatttgtatgagctgtttattttttgtgatcttttttccattgtctttatgcacaggaagttttttctaattatgaaataggatagattatcacaattagttttaaagtgcttttaaaatctaatgttaattttggtgtatagtttgaggtagggattaaaacaagttgctccaactagtcaaccggtttttctagcagcttttattgactattgagtttttaatattcaattatttttccactgaatataccaccttcatcctatcttcatatatgtgtttgtctgtacatcatttatattatgcattgtttgtatgtgtatgtctatatagtttccatactatcttttttgtttttaaatatcagtctattcttgatttaccactatactttaaaacttatagttttataataagttttatttaataagtggcaagatcagtgtatcctcattattcctcattttaaaaaatgtatttatttctttcctgttcattctttaagataaactctagaataaattgccaggcttttaaaatttccctttgggattttgatactttgggaagaatttacattggtatataacttaatcttcccatttaggaacatgtcatgtctccccatttattcttgctttttgttaaggtctcttagcaaatattcgttgttttctccattacaaatcctgcctgcacatttatttaagaaactaattgggccagacgcggtggctcatgcctgtaatcccagcactttgggaggccaaggcgggcagatcacctgaggtcaggagttcaataccagcctggccaacatggtgaaaccccatctctgctaaataatacaaaaattagctgggggtggtggtgggcacctgtaatctcagctacttgggaggctgaggcagggagaattgcttgaacccaggaggcggaggttgcagtgagctgagatcatgccactggactccagccttggcaacagagcgagactccgtctcaaaaaaaaaaagaaactaatcctttgtattttatatttttgcttatattgtgaatgactttcccattatatttattaacgaattattactaatacacaggaaatgtatgttgttatacatgaataatttttaaaattataaatgtattttacaagcagaatatatttgttgcctagtactttaattattattattattgagatggagtcttgctctttcacccaggctggagtgcagtggcaccatcttggctcactgcaaccttcacctcccgggatcaagcaattctctgcctcagcctcccaagtagctgggattacaggtgcccgccaccacgcctggctaatttttttgtatttttagtagaggcggggtttcaccatcttggccaggctggtcttgaactcctgacctcgtgatccacccgcttcggcctcccaaagtgctgggattacaggggtgaaccactgcacctggcctagtactttaattttaatagtagctgcaaagtccttttacatgaattgagtgaattagaggtagttacctcacagtgacttaaagcttgtgggtaaattcaaacccctataccagacataactgataattttaaatgtaaaatgttttacattttagcatacaggtatgctaacaaatgtaataagataacaaacatatactctcaggttataagtcaaaagcctctagaactactattaaaatatacaagcaactttattttgatgtaacagaaaactctttgccctttttaacagcctttgacagaagctcaactttatgaaaaagtagaggcttaacttttctggaaacaaatgtgaacattactaaccttacctgaaaataaagtgtaatggcttacacaggatttgctttcctaaagcacctgcattaacagagccctattctttcatgtttcctcagcagcagcaactaaccaagaagagccaacattcaaatctttattacatcttttcaatcaaagctgaattttaaaagatgaccttataattttgtttctacattgctcacttgtgcacaggcgagacctagtttttagaccattagacagtgatgtgcaccccactcagccccagttgctagtgaggtctaggacttcatcagaacagacctttcaggcgtcctcttcttcccagcttctgcgttcctgggactccaaatccatgaagtaaatgaaaaatccacacagctatttcctgaaatcgtatcaccaagccatttagattgctttatcctgagagatgcaattcctacttttcttctgtctgcctcatacccttcccaagcacttctgagacgtgctgcatttatttatatacataaagtgaggcatgaataaatattgagggtgtgtgtaggtgctcaaggatgaaaacagaactctgttcacttcaaaaatagagcctgctatcaaggggcagttgcctcagatttctggttggtataggcctgtagagagttgggggtgggaggagtagatcaacactgaataaatgaggtagagtgtaagagaaaacctagtttgttcacttatttataactttataggattgtcagaatcatttgtatcatggcaatgctgattaaatgctgttgtttgggcctgaaggtgataattctattaaaaaataatatttctaaggtaccgtctctaaagtgctctgctaaaggctctgacagaggagtgggtgaggttggaaataagaacagagatgctgtcacagtgcatccgggaagtttagctcccaaaattaaaacaatttgggcaggatggaaagaagaaatgcaacagatgtacatgctaatttctcatttactttttcaagtcagagttccagagaaccagagataaagccactttcaaatggtcacagtccagttgatacatgaattaagatcatgcaaagcagaatatgatacatactatatgaaataagcttttgtaagggagtattactctttgaagaggaagtggtattttaactggtttaagaaaaattggaggccaggggtgtggctgatgcctgtaatcatagcactttgggaggccgaggcgggtggatcgcaggtcaggagttcgagcccagcctggccaatatggtgaaaccccatctctatggaaaatacaaaaaaaatttagccatgcatggtggtgggcgcctgtagtcccagctacttgggaggctgaagcaggagaattgcttgaaccagggaggcggaggttgcagtgagccaagatcgtgccactgcactccagcctgggtgacagggactctgtctcaaaaaaaaggaaagaaaaattggagcatgccaagacaggaagattattatgtacacaggtacacagggctttttttttttttttttttttttttttaacaaagacacagaagctagagagtgttgggcctccgtggaagctggaggttttatggtttacctttccaattgcccataaggaagagcagtcagagaccaggttagaaaggctgattgggaccagattgtggaaggccttgaatgtcaatagaggatccctgaactttattctccaggcaacggggaagaatgagatggtgccaagaacactgactgtttatcccacgcaagcacaactcactggacacgcagtgatagtgcaccagggcagctgctttatggaggttactttaatacatttgattaacagtctctacatccagactttcaaggaaagattctaagatattaccttcatcttataagcattagaacatatttcaaaacatatgaggatatatcaaaacatctgaagatatatctggtatttgcccaacagagataattgattctgcaatgtgtgccaaattatatgaaacattcttttaacatctaaaaataatgtttggtatttcctcagatatattttcatttctgctgctagctgccttgggcctcacaattttcattctgttttctgactttcaagttatataccgtggaatggaggtaagtggcattcatttgcacatctggcatgactcatgtacatggaccatgtattcattgtaattcacaagtcaattattactgtattctctttgaccaccaaatactgtgaggctatttctatatactagaagggcaaataagatatctggatttcacctatactggcctctaatggttttcatattattaatattattgggtacatttatcctgtacctacctgaaatattgtttggatactttattatgctatgttataccaatacaataaaattaatgcaataatacaataattttccaagtacaattttcaaaaaaataaaccatatcatagaaatcctttataaagtagttataaagggaaagaaaacatagacttataagacagtcatgttttgtcagatattgactacatgaagttttatatcagtggatataatttgatccaggatgccctgggttaaaatctaattcatcaaggctattgaactaattcttggaccccgtattgtgagagaaataaaagagaagggttggctcctgatctccgagtcatagatttgttgtgaagatgagacatacttgaacgctacctgaggctatccatacttgaaaagagtgtgaagacagacagaactgggaagaacatagaagaaggaggccccactgtggactgtggctgtcatgggaggcatttcattgatgagatgcaacttgacctgggttcaaaagaataggccacattttgccaggtaggaggtagggatattcccaataagaacagcctaagacgcagagaggactgaaagaggttttgttttagaaatgcaaatgaatgtacggtggcagagacagaaatcaaaagcaaggcttacccaagcactagaagactggctaaaactgaggccatgtgctgtggagtatgaacaagaatgaataataaaggcaggcatggatggatggaggcagctagagaagtttagactttatgccaagggcaacatggagtgaatgaagctatctgagcaggcttctcagcagggctctgaagacagactaattagatgacggcaggaagactacatgtgagaggagagacaagcaattaggaaatgaaaacccaagtcattcatttatcaaacacgaagctccagagtgagtttggtactagagttacaaagatgaataaggtgtggtcactgctctcaagtagtttagaagctaggggagaagaccattgcataaataaataattccagggtcaggcatggtggctcatgcctgtaatccctgcactctaggaggccaaggcgggtggatcacttgaggtcaggagttcaagaccagcctggccaacatggtaaaaccccgtctctactaaaaatataaaaattagctgggtgtcgtggcaggtgcctgtattcccagctacttgggaggctgaggcaggagaatgttgcagtgagctgaaattgtgccactgcactccagcctgagagagcgagactccatctcaaaattaaacaaacaaacaaataattcaaaatcaagtgacttccaggtcaagggatggagaagagttagttctggattggagtggtggcagccatgagaaaaagagccaggttctctgctagaatctgacccagcttttccaaacaaccctttaatccaaacaaccctttacaatttgctgtatttcacaacttgattaagactgtctccacctggggaaaaaaatgacaaagtattactttgaaataacccgtatcagcataggggtgagaattagggataagcatttagatactacggagggtcagtgagttttgttctcaagggagttcagtcccacacgcagtcagccataaatattccactcttgggtggggtctcagaaaaaaggctgtgtaactagccttttgctatggatgcagccgtgggaagttatggctctcacactttaaataagcatatttaatgattaatgtgtacccttaaattttaaaaactggtgggtttggagggttcattcaactttcattaacccatcagacatagggccagaagcaatctgcatctagtctcaatcaaaatatacttacatttctctgtcctccttaaagaatgaattccaggtagaatttgctttgggagaattggaaatattaacattatttgatgaatgatttaatcttagccttctgtttgaaaagataaaaatggagacagacacatagcctccaaaatgtcctgtctcgtatttgtgattcagggcacatttctcagtaggcaccatgaggctgtcaaaggtacacaggccaagaggtagtccattctcctttgaattctggttctgccatttatttataggctttgagtccttcagttgtattatctgtaaagggacaaagtaatgcccaccactaagctcagagagttattacaaatctataaattaaataattaatatggtcttttttcaaagtgtgaagtgtgcaaaatataataatggtatttgtttttcaacagttgatcccaaccataacatcgtggagggttttaattttggtggtagccctcacccaattctgtgtggctttctttgtagaggtaaagtaatctctatattttttctaggaagataaacaaattaaggatctcattttcagcaggtgcttattttctagagcaaccactttgatcccccaaaatgacagttattaagggtttattaaaatggtacatattcttttggaggaaaattttggggggaatgatttaaaattatttgaagtctgcatagaaatgttcttgatatcttatgcatagaaagcaaaacatgtatgaactctaattttgcttccatgaatgcactgtattgcacttttctaatattttcaacaatctagtaaagactagaccaggtgaccttccaaccctaaaacccaaagagactttttagagtgaagaactgccttccgcagggtttccataagaaagaggagaagccgttgcttattctagtcaattccttttcttgaaggtcttcctcttacggtgtttcttttctactcagtgtcactaaatgactttacccacttagtaagaggctcaagtattatctttgtaaaaggagagttcttttttgtaaaaggagagttttattttaactcatgtgctttaagactttttggaaaagggatcaaccaaattttaaaatatatatacacctcattatatatgtttaaaggggattccatttttgagactatgttttaataacccaaaagaagagaaaaatactacatgtatgaaggcacttatcataatattatctacagtggcaaaatattacattcaacttaagtgttgttgagatgctgtttgtttaaatagctatacagcgatttgaggaaatgctagtcactaaaaatcattattaatcatattgtacctacgttcttcccataataaaataaaaatttttaaaggctaaagctacataaaaattgtttaccacagaaagtttagcataaataaaactgggatgcaaaatttgaccaatttcattactataaatggataaaaactgtgtgggcatgtgaacaaaagaaaactctcaaaaaatgaaaaccaataaacatttgatttctagagctcaacactttattcaacaaacgcttagacaccttttacatggcaggtggcaggtagcaaggctaatggtgatttttcttttcttcattttgagcacgttattgctgttaccatttcagtctgaggggaaaatcattctaagaaaatccctagccaggacttaaccaggaaatgtgtgaaaaggaaatgctggaagcttctggcagatttccgtgaaaacaagcaccctctagcttcttaagggcagaattccagaacttgggaaaggagaggtagatgcaacagcaatgagcacacctcagaggaaggcctggggaaaggaggtggctgtggtggccagcggcctggctgcagggggacctgcgcaataaattgattgttttcccatctgatttttcaggattccatccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgcatagc

SEQ ID NO: 16 - DNA, 37351 bp, Homo sapiens
atggaacagcggaaccggctcggtgccctcggatacctgccgcctctgctgctgcatgccctgctgctcttcgtggccgacggtgagcgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagaggcgagcggcgaagggtcgccgcagcagcagcgccgcgcccgagtcgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccagccctcaggggcacagaggggccacttctctgtggccgaaaacaggcccacgctgcctgtctgcctcaaaacccacactctcttacacactctagtgtgctcgcgtgcacacacacctacacacacacctacacctacacacacctacattctcccagggtcccacccagagttactcccactgagcctcccgctgggtgctgtccagacacagcggccctccctccagttcttcacggctcccagtgagctgggggaggattttgagccacgcggcagggcctaaggatgcccagagggaaggagaggggctttccttcccaccctggtgtccatccagtctccccagttcagccggcaggtgtgcaccagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggcgccatctgtcgccggttgcagggtcgggttctcttttgtgtaaatcaagggtccaaggcttgagtcccctaattcggctcggcgctgacctgtaaaactccccttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatgcgcccaagcttcccacctggagcgtagaaaggcctggagatgacgaagcctcctcgtgggctcggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggtaagggatcgcggagagggggcgcacgcgcggggatggcgcagggctagggctgcgccgggacgccccggggggctccggacccaggacccgccccctgggcgcatttgcatatgcatactccttcctagttaggtcgggagcgccccccccagggccttcttcccgcggtttctctgtctttactcctggcctctggaagcatttctgatgtgcatttatgaatggaggagggggctgccctgccagctacctcagggtacgctggaggctgtagtgtggggaggcgacctcttttgggtttggagaactggaccctgagggctgagctccgatggtggcaaggggccagtactcagccaccaccggtggtggaaatgagctatccccagatgggggcactggcacctgctggagagcgggaggcggttaaaacttgagttgcgttggtttctattttgtgtgctcgattgaacagactttgtccaagggtgtggaggggcctggctgtgtaacctacgccctctttggctaaatgcaggatggccctaggcagcagctctgcactctgctgtaaatcgcagatcctctccctttggctttggggtgggggcagtaaggactgagccctaagccactgttaggaaggcacccagaggggaaggcttgctttcttagggagctgagaggctgggagaagggattggggatggggggcgggatgtgagaaggcagaaggaggagaaaatgatggcttgactaccccctggtaggcagctctggggcggtaggagccattggcagaggcaggggtgggggcggtggggggcggttatggagggtagaaaggcttgcccagtgtgcccctcctcccaaggcatcccccactctctccccctgctccaagctgggcctcagagcccaccccagtgcctgactgtgagcaggttgctccctcccttggcccctctcctcagtcttgtttgatgcagagtcccacagggagcatctctcctggccacatggccctgggagcctggctttgggtacaggtgcatgtgaaacttcctagatgtgatggagcacattgtcacacccctacagtggtagttctcaaagggtggtcttcctgcaggctcctggactacctgcagaatccgctggggcaggtcttcatgtccttagtgtcaccatctcatcctgcctccctggctaactctcaagccctccgacagttgagcctgcagtctgcctggcacatcagttcagttctgtctctcatttagctctacccactgtagcagccgcctcagtgcgtctcaggctattggcttgatccgaaggcctcatccgtcttggatgccacacaggagcccacaagactgtccctcaggctactggggaaggtagggacctgcaaagagcctccacagcccagctgggaactttccaccctctgcactaagatatcactaggtgctgtgacaaataaaccccaaaaggccagtggcttgacacaattcaaatttaatattcctcgttcatatcaagtcctgccctggagtgccccagggcatgtggcggctctgttccatgcagtcatccagggacccaggctgagagtaccagcctcagcaggaggcttccaaagtcactctgggcatgacatagagccagcagaccagtgaggagagacagaagcagcccttgtcagctcactgccctaagagaattaagccctaatactctcaggcatgcattgtgtatgatgaatcaacttgtttcatatgcatttaggacggccctaagtatgtatcattcttgggagactgagaaaacagccactcaaatctttctggcagcgcttaactctctcagagaaaagctggtttagaaaaatggcaaggcgttttttaagggctaggtctagaagtggtaaatattacttctaccctcttccatcggccagaactcagtcacatggtccaacatggatgtagggcccgctgggaaatgtagtccttggtgtggcggctgctttcgggcctcatctcttcacagtgcaaggggagcgtgactcttcgaggagttagccatctctgttcagcatacaggcagtgctcagggagagttcctattgacttacagagccattggcttaactgatgcttgttggtgaagagaacatccttcttccccctccccttgggccccagcaaggaaatgtgtgcattacaggctgggacgtacctctaggatattcctggaggatttgaaaggcagaagttccgatgtaggttgtgcttccaccacttactggctgtgtgattttaggcaagtgacttaccatctctgagtcatctgtaaaatgaacaggataatctctctgacctcagagggagcttggtatggaaattgctgcacatatatgttcattattatcaccctggtcattagctgcactagctggagaggagaggatgggcagataaagctaaaaggttggcagttggaagccaggctatggagggccttgaatgccaagtggaaccagcagttggttaaagaccggtcaagaccatgtgaaatagatctttgagagtggacttggttgtgctcacaaaatgataatgagaccaaggtcatgagcgcactcctgcttgaatctccctcttcccttggccttcagcctgagtcccaggcccagccacagatgacctgactgcctgccatagccagtctgatctccagtctcggtgctggccatggaggctgaatgagagagtgaagatgctccaggacatctcatccagggaaggtgggccagtcagtgcccttcttcccagaagatatggaggtcctcaggtcaactcaatgctgatggcacagtgcccagtgccatcccagcagataggaccttgggcacccaccagccacggggccatatgttaatgcccatgtgggtcactctgccttccctggaggggctgatgtccactgccatctagaaagcacagcttgcctggatcccagcggggctgacagcagcacccctgggatagaagtacagtggcctctgaggtctctgtcaccccctaacccttgccagctcctgaactggccaggaactgtgtagacacatctcagaaagaacctccagtctctctccaagtctcctttggggtgcccagaaggtgggccttcagctgggaggtcagaaaacctgtgtccctcactctccaggtgaagctctcttgagagtggttctgctccaggcactctatgtcccactctgggcacggaaaatggatggcagacctgtcattcacaaacacatccgaacagccttgatgccaaggagggaaccatgctcagtcttgtgtcccacctcaccccggtcacccaaggccacccaggctgtgtgctgtcaatgtgaagcctgcagactgtgttttggaggatgggcattagtaacctttctgtagggctgcatcaccagccagtgccccgagctcagctgctggcaccaggtactgctgagcgccctgagaggcagcaagccagctgctttgctcggaaccacagcagcctgagctgcagagggagctcggggcagacgaccttgggccttgcctcccagccactcaattctaggcagcttgatggggaggggtccagaaaggaccgctgcctcttggttaatagtcaagagtgtttgcagaggatatcaaccagggtgctggcagaggcacatggaacattcaaacagggtcactgggggggatggaaagagcgtatgtaccaaggtgtggacagggttagggcagccaacaaaggattgatgcaggtccccggggctggcatcagtgggagccatcagcagacctagcctaaaggtctgggggcagctggtagcacccagagagtaggaggggaggcacacagccaacccacagtcacccagcaaggatctcactcctcctgccctccattccctgtctgggcctccctttggccaaaccctcctggaacctgaaggcaggggcacccaggtggtgcaggctgtagaggtcagccctcaggggctcacagcagagtggagaagggtgggctgaggacctgggggcactgaagaggctcatggccaggcacagtggctcacgcctgtaatcacagcactttggaaggccgaggcgggtggatcacctgaggacggaagtttgagaccagcctggccaacatgatgagatcctgtctctactaaaaacacaaaaaattagctgggtgtggtggcaggcacctgtaatcccagatacttgggaggctgaggcaggataataacttgaacctgggaggcggagtttgaagtgagccgagatcgcgccattgcactccagcgtgggcaacaagactgaaactctgtctcaaaaaaaaaaaaagaaagaaagaaagaaaagaaaagaaagaggctcaggacactggccatttcagattggcaacagcaggggcggtcccagtacatctccccaaatagtcccccattaagcgatcgttcctggaaggaagtcagaaaaaaagtccctattttttaagtgagccactttggtaatgccacgaaggagagaggggggacttcctccagccctcatccattagctaccgcacagccaggcaagaaagcccttcccatgccacatgtgtacctaatacacccaaatacatatttgcactaaaagttgatgtgcaaaaactcattcatttcacgtctcatttgtcaagagacattttggtatttgtgcttaaaaataaacatggactgcattagcagagcagagcaggcgcaggaggctgggccccgtcttagctgtgttcataaatctggctcctaattaatctgaatgctgacccatttttcgtgaacactttgttgctggttgccatttctagaaaagagagagagagaccaagcagagtatcttccagactaacacttctaaatggaaaaggcaccgcagtaaagtctagcgcggcctcaaaagaatccagtttgcaactgaatggctggtgtgttggccagaggttcccctctgcagggacgttgggatcagagcagtggcgtgtgaacctctaattagcctcagggctctggctccaaggaaaggcaccatggcccccacagagagccggctggatgtggcaagctgctgctgggtgcccacacggagaactggctctcaatatttcaattaataatgagagaaagacagccaaggccatgggtatgatggctgtagagaggctgtggctgctgggagccgtcaaaggggagcatccgcggatgtcgccatggcaaccgtaaaccgtgaccaaagggggccgtgggcaaggtggagacagtcactacatctcgacccatgccccggtggtgatagagctgaaggaatggcacacacgtgacccaggagaatcgcgatgcagcagagtcaccagcagtaccagcaggcccaggacctgtgggccctgagcaagccattgaggcagccacctggttttcccatctccccggacccacgaggacccaaaggccctcaccttaaatgaacaatccactcttcccccaagttccgatgtgacatgagaattataattaagaagaaaacaaatctggcaagggatgtcccagagaagagagggcgaggctctctgagcatcctgaaaaagaaaattaaaggatttcataaaggaaatggctgagcctcacagctggcaagcaatgcctgcttcatccctaacagcagcaatcttacgccattatcagcgacatggcatcctctcccccagcagccagtcactgggagccttctgggcccagccccacgcttgccataagggggaaccagagatggcagtgtggacccaaacttaaaggagccagggcacccaggtaattccaggacaaagcagtctgtgctgtgccagcactaatccagctgaggcaatcaggagaggcttcctgtaggtggtgtgtgacttacagcttgaaagaagcacctgaggctgaagtcctcccaattaggtcagaccttggaaagctttcagatgccccctctctccttcccaaggttggagaagtccacaccaaatggaatggcctttgtgtatcagtcagctcactgggcaaccatcctctcagcatcagcaagaccctaaattcaggataaaaacagctgctcttggattataataatgataaataataacatttgccttttactgagcacttactgtgtgccacgctctcctctcaccggctttcctccttcccacagttctccctaatgcctcctgcttcagtccgtcccccagaagacagagcgctctctctgtgcttatagccagagcccacactctctgcccagctggagtggtagcccccaagaaaagagctggaagccagccttgttaaatgtcaccgggaactaaccccccaacaaggagctgctcattaaacacgccaggtgcatatccttaaagctctgaatattaaggattccccaagcatccgtggggataaatgaggtcaagtgcttttgtaatatgatattgattagttctgctctgtgtggacagagcaaggccttggctgtggtctaaacccctgagctttctggaagatgccagcatggttttaagacatttttgcagcacaggagaaaaataaaagcattatcttttttattcccccatgcttagctgactatcaccaggcatctcttgtaaacttgtatccagagtggtgagaaggcttcactttgccttacataagggctgcagggaagtttgagatgggaagtcagcaggctcagcccctgtaactcttgattcctgactattcctgatgaagaatgacacacctccttccctggggtcgtgcttctagggaaattagcctgcttgtcagtggctttggtgctctcagggaagatgtgctataaataccaagatggaggatccagtctggcctcctgtgggttagggtgtagctgctgttaaacagccagcggtggaggtggctgcgggggctgcttgcagacagcagcaccctcggtgaccgcaaagtatgagcatagcccaggccccttctcctgcctgcatcctccacaggacggcccttgagagacagaccttgtgcaaagcctgtccctgccagcaatcctgtttctggaagttattggttgttctgttctgtcgttactgctctctgggctaaaatatcaaagctactttggacaggcttcagttggctctggttcttgcagttcaagaggaacgttgaggggtcctggcgttggcatgaaataaggagccaaagtggacatttcggaagcttttccccacaaccacccgcccccacacccacctactctcccgcacccacctactctcccgcacccacctactctcccgcacccatgggccctgctccatgcagctcagaagtaaccagcttgccagaagggccactgagagggacagagcaccccctaaaagtcccagttgagcacccaatgcccgctagagaccgaggccaggaaaattacctaggcagatcagtcctccccacagctgcccatgctggtgggagaaccaaagcatcacccgagggacactgaacatagttccggaggaagttacactcaccaccacttccaaccatcgcattctctcctgacatttcaaatgttcctcactgttcagcatgctggctcacaggtaagccaggatttcaatgccaacaaatttgccccctttctgggcctttacagggctctggccctgcaaaagtcacagcatgtgcttctcactcctgcccttcataccctaagtattatgcttgttttccggatacatccaaccatttgattggaatcttgagtccatcacttcccactctctctgtacgagttccgtcatctgttatcatcagcacgacaccgattcctatgccagagagtggttggcaggatccggggggataatccgtggaaagatgttagcttaacacagggcctggcacctagaatacactcagtggatgttggctttggtaaccagcgttattcacgggaatggtgttaaccatccaggatcgcttactaagctggacagggtgctccgatctgagacttccttcatgagaccgccctccctcctgcaaatgctgtgagcatgatggagctaattgtgattgtattcatccattttgcattgctatcagggaatacctgagtctggtcatttatagagaaaagaggtttatttggctcacagttctgcaggctgtgcaagcaaggcaccagcatctacttggcttctggtgaggcttcaaggagctttaactcaaggcaggggagtagacatgtcacatggtgagagaggaagcaagagagagagggaggatgtgccaggctctttaaacaaccagctgtcatgtgaagtaacagagtaggaactcacccattacctcattaccatgaggagggcaccaggccattcgtgggggatccactcccatgacccagttacctcccaccgggacccacctccaacactggggatcacatttcaacataaggttggaggggatgaacatccaaaccatctcagtgatggggctgatggagctcagaaacagaaagggccatcagattgcaaatggctcggagagttgctgtttttgtaagttctctggctgcaccatttcaaggggggaaggtagaaagatggggatggtgccacatccccatactagtctggttggggctgtttgccataagtcacgagctccttggtgaacaaggacagcttcatcatggtttcgtgtggtccatcagcaaattaaacccccaggtttgcccacgtgccgagtcctggctgtgctaacagggctcctggggaaagctgctccatgtcatgcctggtcgtgcttctttgtcatataggctgctgccagtggcgcgggcactgtgatgtgagggggtagggcctttcgggtggcaaggagaagctcagaggagaggctggtgtttgcagcactggacagctgtgtctccaggggagaagtggggagaaggtagaaagctctctcaccatgtcatatagccagagagcctcctggggtaggtctagactgagaggaggtgcccgaagtccccatcactggggcctttacagagatagagtgagagagagagtgagagccacctatgtcagggagtgccccacagggatgggccttttggggactcacgccaccgttacaggctcaggacatgtgctggttcttccacttgcgttcctgcattttgcttttcatgttcgcatccaccccagcttccctttccgtggctcactgtgcccagagattgctaataaaggtgccacttggcaccgaggctagtgagaagaatgcaggacagagataccacctctgggatgtgctgggagtgtaagcaggctgccggccaggccaggaagccagggcccctcctgcctgtctccacccctcacgcccatgtgagcctgcctccctcccagcacagacagcccactgcagactcctgctggaggcccacccacctgtaatcgtatagctctagagacagagagccttccctctgctgaccctggcctgctgtccatcagctgccctcagggaggaaggcatggttttctttaaggcaggaaagcccagctgcaatgtcagtccccttagagtgacttttattacaattgattctcatacaaatgccgcttggcccagaggaaagatctttaataaacccatggaagggggagctgacatcacatcaggctcagtccgagtggggggtggggattcctggtctgctgtatctggtctggcccaggccaaggggcagggagctacccagagcatcaggcagacctagcccctgccccaggtaggagctcatggtctagttatggtggccatgcaggaggatgaacccagggctcagctcaggcacaagaggggctcagaaatggtgggctaccaggatggactagtagttgggaagaactcagaaaggtggggccagggtgggctggtagttgggagaagacttcctgatcctgcagccaaaggagtttctttcattctgagcacctagatgtgccttgctgctgcctcagggctcccagcagttctttccctgtcctgcagtcaacacctggctgagtgccccatccagactgatgcccacagacagcaggcctggttcattctcactgctgtttccccactgtcctatattcattggacttggtactagttcattcattcattcaatcattcatccagcaaatgtccatggagcatttttttatgtgcaggaacttttctagtcactgagggcataatgtgattaagactaatgaggtcctgagaaagtgacagaggaagagacagatattgatcaaatagtcacatagcaagtggaaattagcagccatggctggtactctaaaggagaggcccatgggctatgggagctaaaatagggagatttgacccagtcagggaagggtcaccaagaaagtgacatttgagccataatcaggaagacagttaagagttggccaggtaaagaaagaaggtagagctttccaggaagagggactcacatgtgcaaaggtcctgcggcaagagggatctggggaaatgcaaaggcctcacagaagcttactgtggtgggtgcagagaaagcaagatggggaagcaaaggggaaattaagtcaaggttagagtttactggtcaaacagggtcaaactgtaaggccttttgaagagatcaggaagctttgactttatcctaagagcagtgggatggggtttgagtggctagggcatgatgccttcagaaatggtcactctggttgcaatgtggagattggagaggtgggatgaatttgatagatggggaagaccacttaggaggcagtgatccagtcaagagatgatggggcttggaatcattggatggatgggttgatggatgtctgaatggggtgataaaaacaagtagctggtgggtgagtgaagggaaggatgtgtgaatggatgggggatgaatgggaggaagaatgaatagatgggtggatgatggaagaatgaatggatggggagaaggaagaatgagtggatgagtggatgaattggagaattaatagatgggtggaaggaaggatgaatggatgggataatgaatggatggaataataaatggatgggataataaatggatgggtggacagaaaatgagtggatgggtagatgggtacatagaagggagaataaatgggtgggtagaaggatgataagttgatgggtagttgggtggatgggtagaaggaaggatgagtgaataggtagatgggtggatggtgggagaattattggatgggtggaaggaaggataaatgaatgggtgaatgagtgggagaatgaatggatgggtagaaggagaatgagtggatgggtagatgggtgggcagatgggagaatgaatgaatggatacaaggatgacgagtggacgggtagatgggtgggtggatgggagaatgaatggatggattcaaggatgatgagtggatgggtagatgggttgatggatgggagaatgaatgggtaggtagaaggatggtgagtagatggtagatgggtgagtggatgggagaacgaatggatgggtagaaggatgatgagtagatggtagatgggtgaatggatgggagaatgaatgggtgggcagaaggattataaatagatgggtagatgggtggatggactggagaatgagtggatgggtagaagaatgataagtagatgggtagatgggtgaatggatgggagaatgaatgcatagatacaaggatgatgagtggatgggtagatgggtggattgatgagagaatgaataggtgggtaagaagaaggatgaattaatgtgtgagtgggtggatggatgggagaacgaatgggtgggtaagaagaagggtgaatcaatgtgtgaatgggtggatggatgggagaatgaatggatggatagaagaatgatgcgtagatgggtagatgggttgatggttgggagaatgaatgggtgagtagaaggaagatgagtggatgggtagataggtagatggatgggagaatgaatgggtgggtggagggatgatgagtggatggatagatgggtgaatggatgggagaatgaatggatggatggatggattgatggatgagtagattgggaatgagtggaaaaataaatagctgacgcataggtggaaagaagatataagtgggtggatgggtgaatggagagtagaaagtaggagaaatgggtaagtaggtaaaacatggatggaaagatgggtagatttgggatacaagttgaggcttgcaggatgggtgggattgggattgcaggcatgcctaaggttggagtttccagcaactgaatactgcacactcatgtcttccaggaaggaggccataggaaaaaagtctccaagtggtggtaggtcccagaattccatgccattccatgcttctgcctgcagtccctaggccactgaacctagacagaggggaagggcagagtgagtggacacagccaatcccagcctgcttccgactcccctaatccctcagcctttagggacaggagcagcggacctcctccctctgctgggcactgggtactctggtggatgcagcctggcccagatttgctgattcttgtccacgtacaaattaatgtagatatgttttttcaggcatttaagaaatcccatctccaggtgggcagataaataactctatttacattaaagactaatgtaacaaaaatacaccaggcaataattcataatgcattctattctacagagtcatattttaatgtgtgacatatcccaggcagctcctctgtgctaatttcatttaatgagcacatgttatagaattttcagagcactatccctgggcaattaaaatatgttaaccttttggttaaattgtgtttctaaagaaaagtcctcactgtgaaacagaaagaaatatccaggtgtcactgaggtggaacccaaaggcggattgtaatgggaaaggactgctgttaggtcctgcatgtgctggctggagggacctacagcctcctcccggacctcaggccatgctgcaccatccctgcccttgcatggccaggcccatttccactgtgcaggacaaggagctgaagcctggacccatacagtgagcagccttccttgagcagtcattaattgactacccactatttgcctgacccaggagatccaaggtacaccctggctccaaggttgggaagattgtagcatggaggtgaggtacccccagacaactggggtttaaatagggctagtataggagacttcaaggaggggcaggctcctctctttcaaaatatggacaggtcccccagctctgccatctacataatgggcacaccagtgctccagcattcccaagtcccagagtttcagatctggaaggggctcttagagagcctagtgtgagtgattcccaaactgtgctccttagaaccccaggagccccaccccaacttcaaccagagccattctgcttctaatggttttacatattggggttccatgaagccattagttgaaaatagggttctactgctttaaaagatttaaaagcagtttatatagttctcctgtgtgtatatatatacctatatatatatatatgcacattatattaaatatatatttatgcactttatattaaatatacaaatagttttcatatatatgctgccttctaagggaagaatttgaagtggcttataaaactgaatgtgcggccgggcgcggtggctcacgcctgtaatcccagcattttgggaggccgaggcaggcggatcacgaggtcaggagatcgagaccatcctggctaacacggtgaaaccccgtctctactgaaaatataaaaaattagccgggcttggtggcgggcacctgtaatcccagctacttgggaggctgaggcaggagaatggcgtgaacccgggaggcggagcttgcagtgagcagagatcgcgccactgcactccagcctgggcgaaagagcgagactctgtctcaaaaaaaaaaaaaaaaaaaaaaaaaaaaaaactgaatgtgccataatagaatgaaaagtttttaatgagcaaattggaataaaaggaaaatgaaggtgaatttgtgaaatcatcttgagaaaaagttagacaaagacatgtgtactggcagtgttgggaagctggaaggtgaggtcaaggtcactcttgcagccctgggctccccagagggaactcgagacaggcctctcagccccagcttgtatctgaaggttaaaaatgcgaggccacctttgaaggacctggcccatgtctggtgcattatggatggttagaccagctgggatgtctaagaaagactttcattcatgcattcaacaaacattttgtgagcctgtcagggttccggcaccgtgctgggtaatgaggacatatgcagctgagacagccatggtctccactctctcaggcacacccgctagcagagaagacaggggtcagacagtaacacactacggccatccacatacagccccgaagaaatggaacttgccttggagcctgtaggacaaagggagcctccagactgggtcagcgagggcccaatgtctgaaggagacccatggtctgaggaggacggaaatgagtgaatgggaggtctccgggggtcggcagggtggattcatgatggcactgggaggcaggcaggggtgcggggagagaggtagccaggcgagaagagttaggtcttcagcctgagacagagactcctgggaacttggggagcaggaggaaattgtgctttgcatgtgaaaagagtactctgggtcgggcacggtggctcacacctgcaatcccagcactttgggaggccgaggcggttagatcacctgaggtcaggagtttgagaccagcctggccaacatggtgaaaccccatctctactaaaaatacaaaaattagctgggcgtgctggcacatgcctgtaaccccagctactcaggaggctgaggcaggagaatgacttgaacctgggaggtggaggttgcagtgagccaaaatcatgccattgcacgccagcctgggcgacaagagtgaaactccatctcaaaaaaagagaagaaaagagcactctgtttctgcaaaggacatggtttggttcttttttatggctgcatagtattccatggtatgtatgcatcacattttctttatccagcccaccgttgatgggcatctgggttggttccatgtgtttgctgttgtgagtcatgagtgctatgatgaacatacaggtgcaggtgtctttttggtagaaccaacctgcacatgtaccccctgattctaaaataaaagttgaaaaaagaaagaaaagaaaagaaaagaaaaacggcactctgggcagccacgttagagtgctgggctatcagtgactggcttgcgggggcttggtggatgcagggaggccagtcaggagctgctgcccccgcccaggtgagagctgatgcagtgagggggagggttggagtgccagggcagggtgggtgtggggtaatggcaggggcaggaagtagatagattcagagctgtattggagtcaacttgtgggggcctctgagatgggccagagaagatgggtgagcttgaaagagccagagaggaacaggaaaggaatctagcaaagggaacagactgagcaaaggcctgaattcaggagagcctgggtgcatgcagcccccagcgcaagagccccatttacctggagctcaagacactcaaaggagtgtggagacaggcaaggcggcactgtccactgggtgaaagggcttccagctggctaaggaacttggactcattcataggtaccaaggagtcactggagataaccttctaccacctacccactgtgtgaccttagtcaagtcacccaacctctctgggcctcacctatgaacgggaaagtggtttctacctcctaaggctgctgagagagataaaggggaaaattctcttgcaggggccgagtgcagctgctggcactgagaattgtgtgcctttttacagcccacaggctcaaaggttagcaatccagatggggcaggggcccctcaggtgaggaatgggccccacactgagggaggcagcctcgccgtccccgctggggagcccccacccccaccccggtgctcactgcagtcgggccgcctgcggccccctctgacagcagctgcctgaccacagagtaaaggcctgtttgccattcacattaagtgacatcattaaagggccattgggggcaagatgttatctcaaaagagatggaaaactggagaggaggtggcggcaaagttggccacattaaaaagccaccatgaatgttaacattcagggaaaaatctcatcccccattctccttcccttgcaagtagccaggggccagggtcaggctgaggcattcatggggaaggagagttccagctctttgggcccgagaggtggtgtgtgtggcagtggttaggtgtacacaggggccagactgcctgggtgcaagtcccagccctgctgtttatctcagtgtggccttggttgggctgccagatttagcaaataaaaatataggaccccccgttaaatttgaatttcagataaaccaccagtaacatcttatgaatgtaagtatgttccatgcaatatttgggacatacttgtactaaaaagtatccattgtttttctgcaattcagattcaatggagtgtcctgttttttatctggcaaccccaggcctggggcaaatcacttcatctccctggacctcagtttccccaactataaaataggagtaaaagtaactcctgccattacaaggattgaatttaacgtaggtcacatacttgctgcagtacctggccctaataagtgctggcaacctttgccttgttatcctaaaggtgctgggttctgtctgcttgactggtctggtccctgacatctgctcttgactagaggtcatcagttgcaacaccaggcaattgccatgtcctggttttgggtggggctgcttgctgggggctgaggagagagggaggccctaggccagccctctgacgcatgggcttcctccacgaccagagaggtaggacatgtgaggaaggcacttagggggtagcagaagagaagaaggcagaggcaaggggcacctaaacaaacagcacagacatttgtgccaagccctctgtgtttgggtgctcagggagggctgcctggaggaggcagcatctagacaaaggaaaagtagggggctagtcgttctgcggggtcagcctggatatgcctgtagggaaccagagcacatggctgcagcaggggaatggtcagattgaagtggggggatggggaattacggacaaaccccaactgcggcactcaggcagtggctctttctcctgtgggcagagggcagtcatcaaaggttctgtttctcagggagagtgtccaggtgcgtctgaaggatggagtggttatgaaggcaggagaatgctgtaggggccactgctgtcattgggcatagtggaggcctgaactggggctgcagcaggggagagagggcacagcagggaatggctaaaacaggcggggaacaggcagtccagccacatttgcccaggagtactcaggctccttccacgtcctggacacggaggcagccatctgggcatcatcaccaagggatatgacgtcacccccaggaggacagcttgtctgcaaacccaggagctgactacccagggcctggaagcgagggacagggcaggaggacctgtgcatgtctcgtctgctctcaaaggtccgcaccccacactggacttttctttaaaatatctcgatttcctttaaagcccaactgcatcagtggccccttgcttctgccccagttacagtacacattaattttatggcagaaactaattctacccgaactccgttagtgttcaattattcctcgctgactgcctttgaataaatatccatgaagaggcttttaataaaacatcaacaagggaggcagcctccttgcaaggtggcagaggttctcaccctgcagcgggctgggccagtgctgcgtccaggggagagctgggagccaggttctcagcagggcctgggagatcccgccagatgctcccagggtggggcaggctcaggagccccatcaggaagccgggaatgtgggagctaggagagccagccccctacatgaaggaaggggtgtgtctggccacacaactgcatggggacaaagataggatgcataccaggcctcctgggtcctgcgccaggcctggcacatagagtgcaaattcaggcacccacaaagggccaggttggctgagcaaaaggggcccaactgcgcaggaggctggggcaggactggcagctcaccctgggcccaggctggtggctagcagggagggatgaggggaaggatttctgctgggaagagcagccggcccccacccaccccagtgttctgtagcttggtggaaaagcagtcctggggttgctgattctggggcctttctaggaaatacctgaatctctgcttttatgtagaagtctcccaatttttacatgccagattataatttacaatttgtaagactctgtgtgcaccaaactagacccttctgcaaatcagacagccctcaggtggccacttggtgcctttaccttgtccctgggctctgtagaagacagcattttgtaaccaggaaatcagggagtggggcaggcagggaaataagaagactgaaaggccaggctctgggggagtcccaacgctgcccccaatgctgcacccatgctgccccaggggagctctagcactggccgcagtgctgccccaggagagcctgatacttcccccagtgctgcctcaacattgccccaggagagccccaacgctgcccccagtgctgccccaggaggtccctgacgctggctccagtactgccccaggagaaccctgatgctggccccaaggctgctctaggagaccccagacactggccccaatgctgccccaggagacccctgatgctggccccaatgctaccccagtagacccctgacgctggcctcagtgctggccctgacacgggccttggcatctggaccatatatgtctccccacagggaaaaggatggggtttgactgtagccaggatggctactagatgccctctcctactctcactccacaagcccctgcaaacccagagaaattccttgtacactggccccaggaagctcggagacggaggctcctccttcagctggggcatggccttctgctgcactcctgagcgggccccagggcaggtgatggggaattgggaagagcaggtctgctcccagctgccccaggcagacagccatccccatggctaaatggatgttcaagtccagcccattaaggccatgattgccccttgggggctgccttcttgtttcattcttagatgacagcaaaagagactagaaataggcttgaacatcagagctgaggggcccctatccaggaccctcagcttggctctctaacctttctagccaagaagcccttgttctgactaaagatctgttataagccaggagtggtggttctgacctataatcccaacactttgggaggccaaggcgggaggatcacttgaggccaggatttgaagagtagcctgggcaacatagcaagattccattattaccaaaaaattttaaaattatctgggcatggtggcatgtgcctgtagtcccagctactcaggaggctgaggcaggagaatcacttgagcctgggagttggctgcagtgagctatgattgcaccactgtactccagcctgggtgacagaatgagaccctgtcaatcaatcagtcaatcaatcaatgtgctatgacagcacaaaatgcagaacagacatgagtggccttgatctgcttgacacagaggagggacctgtctgtgagacctccatggttgtcctcatggtagaatatccaagcttgctgttggaatggctttgtctgaagacgacaatgtcttcccttgaactagctcttctctagtggctgcctgtactcggtgtgtgaatattctatgcaatactggacaaagcaagtgaaagacagaagcactacagcgtcagcctatgaaatgagcctccacttagccaggctgcaagagccagaccagcctgttgtccatttttgtgtgtagagccagacctcaaatgtgtcttcattttacttactcttctcaaacctgaaaaaaaaaaaaagcagcactgtttgcaaacccctgaccccagatgcagctcccaggccaccagcaggtttgcaggggcaagggacctggccaggcccaaaggatctcagccccagtggagagggctgcagctctcttctaagccacggccagaaaacaagggccacagactacagctggggcccatattaccccaaaggcagagggaagccatccatacttctagaaacatgggcagcagtggctgccctggcgagctgtgcaggctggtaagctgggagccccctactgtgatcccaatgcccacagggtaggagtggcccctctgcactccgttccacagcatagaaacagatactccatgccgatggaagtcccagcccatatgggtattcccaacccttctccccactctccaggaagctaactcacaggcttgggcagagcttgggtcagacgatggcctggaggaactttcacctttacttttagcacaaggcatgaaatggcttgagagctgccatattgctttctggcagggatttggaattctgcttttgcttgataaattgaaatgaggaatttcccagacaagctgctgggctggcacctttagtgtgcttatggtggggtggggggcagggggaagtagagatgcccgttgtgttctttgagggtctctttcaaatggctccagcgtgtctcttatcctgctcactatctgaatgataaaaattaatatcttaattgatatcttaatcttgagccaaagaagctttgattcctttaagaagagtgattagcaaaatgatgatacttgcttaatataaggaatgaatcagctactgttccatcagagggcttccctcacctctcaagcagcctgattttgcaccttaatcatgacaaataaacttgctcatgctccagcgctattcctggtactccttaggacaggagggaatagataaagaaaccattagcatccagtcaatgcatcagcctgcatgccagccagcccgctcagcacacaacccccaggaacacagatgtctccacgccatgtaaaaaaagaggctacagggatgggaatgagatcctacctcagtgagcagaacgtaccctctgggccttgccttgtagggtcaatttgggcctgggacctgtcattctggaaagcaatggacagcagaggccaagtgctggacattggaacagacagtgtgatcctgggcaacatccttcacttctgtggatcttgtgtcacatttggaaaaggaggcaatgcctggggagcaggtggacacagggctgcaagactcctgagctctgaaccattgctgatgtacagaccccacttactcagggtcagcctggaagccagacttccttggtctgccccgattcatttgggaaacctagattgtttatatgtctgatgaatcaggtagtaaaaggttgcaaatcctaggtccttcttttgccaaagatccagggatgtctcaaaataagtggttgaggaatcctgcataggcaactggggtaaccaggttctctcactggtactgacgtcgttggcaagacccatggagagcaaggaaaagcagggtggtgcggtggcccacctgggagccgcatggggcaagggaagcacctaccaccagccaagggagtcagtgagtgatcatgctaccttacccaggaaaccatgctatttccacagatctgtgaaacctgtgggtcaggggatctccctcatgagcccgtgccaccagggccttgggtcccaagcacgccactcagctagagactgcctaagactactgagttccggggagaggggcagctgtcatcactgaggctgcctgctgcctaagatggctaagctcccagggggaagggcagcagccatcactgcagttccagtctgctgcttttcccctgccagtactggggagactaggtggtttggacccaggaggaattccccacagtgcagcacagcagctgtggcagatcaaggtcagactgcccctttaggcctgacactgacccatccctcctcacctggtggggcctccctgcaggaatttcagcaactacagccaggcgtatagggacagagctctgatctccctgggactgagcccctcaggggaggggtgtctgcggtcttcacagatcagcagacttagtcttttcccctgctggctctgaggaatctgggcagtctggacaagtgagatcccccccagcatagcacaccccctctgccaaggggtagcaaaagtgtttcattaagcagatcccatgcctgctgaccaagaccccccacaacaggggtcaccatacaggagtgttcatgctggcatcaggttggtgcccttccaggatggagatcccagaggaaggagcaggcagccatctttgctgttctgtagcctccactgatgacacctccaggtatgggagaaaccccagtgaatagggtctggagtggacccccagcaaaccacagaagccctacagaagcggggcctgactgttaaaacaaaagcaaacaaacagaaagcaacaacaacagcatcaaccaaaaaagtccctgcaagaaaaccccatccaaaggccagcagcctcaaagattgaagctacataaactcacaaagatgagaatcaatgaaagaacactgaaaactcagaacgccagagtgcctcttctcctccaaatgattgcaacatctctccaacaagagcacagaatggggcagaggctgagatggatgaattgacagaagtaggcttcagaaggtggataataacaaactttgctgcactaagagacatgagaaaacattacaggagctgttaaccagaataaccagtttagagaggaaccgaaatgacctgatggagctgagaaacacaacataagaacttgacaatacaatcacaaatatcaatagccgaattgaccaagtgggggaaagaatttcagagcttgaagactatctcactgaaataagaccagcagacaagattagagaaaaaagaatgaaaaggaatgaacaaaacctccaagaactatgggattatgtagaaagaccaaacctacaactgattgaagtgcctgaaagaggtggggagaacagaaccaagttggaaaacacacttcacaatatcatccaggagaacttccccaacctagcaagacaggccaacattcaaattcaggaaacccagagaaccccagaaagatactccatgagaagatcaaccccaagacacataatcatcagattctccaaggttgaaatgaagaaaaaaatgtaaagggcaaccagagagataggccagatcacctacagagggaagcccattatactaatggtggacctcttagcagaaaccctacaagccagaagaaactgggggccaatattcaacattcttaaaagaatttccaacacagaatatcatatccagccaaactaaactttataagcgaagaagaaataaaatcttttcagacaagcaaatgctaagggaatttatcaccactaggcctgccttgcaagagctcctgaaggaagcactaaatatggaaaggaaaaacttttgccagccactgcaaaaacacactgaagtacaaagaccaatgacactatgaagcaactatgtcaacaagtctgcaaaataaccaaccagcatcatgatgacaggatcaaatgcacacataacaatattaaccttaaatgtaaaagctctaaatgccccaattaaaagacatagaatggcaggctgataaagagtcaggacccattggtgtgctgtattcaagagacccacttacatgcgaagacacacataagctcaaaataaagggatagaggaaaatttaccaagcaaatggaaagcagaaaaaagcaggggttgcaattctagtttctgacaaaacagactttaagccaacaaagatcaaaaagacaaagggcattacataatgataaaaaggatccattcaacaagaagagctaactatcctaaatatacatgcacccaatacaggagtacccagattcataaaacaagttcttagagacctacaaagagacttagactcccacacaataatagtgggagactttaacaccccattgtcaatattagatcattgagacagaaaattaacaaggatatttaggacttgaactcagctctggattaagtggacctgatacatagctacagaagtctccaccctaaaacaacggaatatgcattcttcttggtgacacatggcacttactctaaaatcgatcacaaaattggaagtaaaacactcctcagcaaatgcaaaagaactgagatcataacattctctcagaccacagtgcaatcaaattagaactcaaaattaagaaactcactcaaaaccacacgaccatatgaaaatggaacaactagctcctgaatgactcctgagtagataatgaaattaagacagaaatcaagaagttatttgaaatcagtgagaacagggacaatgtaccaaaatttctgggacacaactgaagcagtgttaagagggaaaattatagcactaaatgcccacatcaaaaagctagaaagatctcaaattgacaccctagcatcacaactaaaagaactagagaaccaagagaaaacaaactccaaagctagtaaaagaaaagaaatagttaaccaagatcagagtggaactaaaggaaacagagacatgaaaaatccttcaaaaaattaatgaatccaggagctagttttttgaaaaaattaataaaatagttagactgccagctagactaataaagatgaagagaaagaagaatgaaatagaaaataaaaaatgataaaggagatatcactactgaccccacagaaatacaaacaaccatcagagaatactataaactcctctatgcaaataaactaaaaactctataagaaacgaaaaaatttctggatacatataacctcccaagactgaaccaggaagaagttgaatccctgaatagaccagtaataagttttgaaattgaggcagtaataaatagcctaccaaccaacaaaagcctgggaccagatggatttacagctgaattctactagaggtacaaagaggagctgttaccatttcttcttaaactattccaaacaattgaaaaggagggacttctccctaactcattttgtgaggccagcatcatcctgataccaaaatctggcagagatacaaaaaaaaaaaaagaaagaaaactttaagccaatatccctgatgaacatcgatgcaaaaatactcaataaaatactggcacaccaaatctagaggcacatcaaaaagcttattcaccacaatcaagtcagcttcagtcctgggatgcacaaaacataattctaaacagaacgaaagaccaaaaccacatgattatctcaatagacatagaaaaggccttcgataaaattcaacatcccttcatgtcaaaaactctcaattaactaggtattgatggaacatacctcaaaataatgaaagccgtttatgacaaacctacagccaatatctacagaatgggcaaaagctgaaagtgttccccttgaaaaccagcacaggaaaaggatgccctctctcaccactcctattcaccatagtgttggaggttctggccaggacaatcaggcaagagaaagaaataaaggatattcaaataggaagagaggaagttgaactgtttgcagatgacatgatcctatatctagaaaaccccattgtctcagccaaaaagcaacttaagctgataagcaacttcagcactctcaggatacaaaatcattgtgcaaaaatcacgagtattcctgtgatagacaagcaacaatagacaaaaagagagccaaatcacaaatgaactcccattcacaattgtttcaaagggaatcaaatacctaggaatacagctgacaagagaagtgaaggatctcttcaaagagaactacaaatcactgctcaaggaaatcagagaggacacaaacaaatggaaaaacattccatgctcatggataggaagaatcaatgttgtgaaaatggccatactacccaaagcaatttatagattcaatgccattcccattaaactaccattgacatgcttcacagaatcataaaaaaaacttttaaaattcatatggagcccaaaaagagtccatatagccaagacaatcctaagcaaaaagaacaaagctggaggcatcatgctacctgacttcaaactatactacagggctacagtaaccaaacagcatggtacaaaaactgatacaaaaacagccacatagaccaatggaacagaatagagaactcagaaataaataagacgcacatctgcaaccatctgatctttgacaaacctgacaaaaacaagcaatggggaaaggattccctatttaataaatggtgctgggaaaactggctagccatatgcagaaaattgaaactggacctcttccttacaccttatacaataattaactcaagatagattaaagacttaaatgtaagctgggcacggtggcttatgcctgtaatccagcactttgggagaccaaggtgggtggatcacctgaggtcaggagttcaagaccagcccgaccaacatggtgaaaccccatctctactgaaaatacaaaaaattagctgagcgtggtggtggatgcctgtaatcccagctactcagggcgctgaggcaggagaattgcttgaacccgggaggtggaggttgcagtgagctgagatggtgccattgcactccagcctgggcaacaagagcaaaactccatctcaaaaaaaaaaaaaagacttaaatgtaaaacccaaaactataaaaaccccagaagaaaatccaggcaataccatttgggacataggcacaggcaaagatttcatgacgaaagtgtcaaaagcaattgcaacaaaagcaaaaattgacaaatgggatctaattaaactaaagagcttctgtgcagcaaaagaaactatcatcagagtgaacagacaacctatagaatgggagaaaattttgcaatctatccatctgacaaaggtctgatatccagaaactacaaggaacttaaacaaatttacaagaaaaaaacaacctcatgaaagactgggcaaaggacatgaacagacacttctcaaaagaaaacatttatgcagccaacaaacatgtatatatatgtatatatatataaagctcaacatcactgatcattagagaatgcaaatcaaaacctcaatgagataccatctcacgccagtcagaatggtgattattaaaaagtcaagaaacaatagatgctggaaaggctgtggggaaatagaagtgtttttacagtgttggtgggaatataaattagttcaaccattttgggaaacagtgtggtgattcctcaaagacctagaacaagaaatatcatttgacccagcaatcccattactgggtatttacccaaaggaatataaatcattctattataaagatacatgcacacacgtgttcactgcagcactattcacaatagcaaagacatggaatcaacccaaacgcccatcaaccatagactggataaagaaaatgtggtgtgtatacaccatagaatactatgcacccataaaaaggaatgagatcatgtcctttacacggacatggatggagctggaagccattatcctcaggaaactaatgcaagaacagaaaaccaaacaccacatgttattattaataagtagcagctgaacaatgagaacacatgaacacagggagaggaatgacacacactgggacctgtcagtggggaggttaggagggagagcatcaggataaatagctaatgcatatggggcttaatacctaggtgatgagttgataggtgcagcaaaccaccatggcacatgtttacctatgtaacaaacctgcacatcatgcacaagtgtcccaatacttgaaataaaaatttttttaaaaagaaacataaaaataaaaccacaatgagataccatctcatgccagttagaatggcaatcattaaaaagtcaggaaacaacagatgctggagaggatgtggagaaataggaacacttttacactgttggtgggagtgtaaattagctcaaccattgtggaagacaatgtggctattcctcaaggatctagaaccagaaataccatttgacccaacaatctcattactgggtatatacccaaaggattataaatcattctactataaagacacatgcacacatatgtttattgcagcactgttcacaatagcaaagacttggaaccaacccaaatccccatcaatgataggctggataaagaaaatgtggcacatatacaccatggaatactatgcaggcataaaaaagatgagttcatgtcctttgcagggacatgaatgaagctggaaatcaccattctcagcaaactaacacaggaacagaaaaccaaacaccacatgttgtcattcataagtgggagttgaacaatgagaacacatggacacgggaggggaacgtcacacactggggcctattgggggttgaaaggctaggggagggatagcattaggagaaatacctaatgtaggtgactggttgatgggtgtagcaaactaccatggtacgtgtatacctatgtaacaaagctgcatattctgcacatgtatcccagaaccttaagtataataatattttaaataaataagtaggtggttgaagagatagtttgccttgcttgttctagcttggaaaattttcctcttgagagaaggaaatccgcaacctgagaaagattattctccagcccttttaaagaagaagctatgtcacccttttctgtaacatctatttgcatggcacttgactctgtttgaggcgctgttgtttacatgtttgtattgttagcttttgatacataatgaaggaccccaaaactcaatggctttggcagaacaccacagccgtttttagctcaggattctgtggctcagcaatttgggctgggctcagttgggcgattcttctgctggtctgttgggctcattcatgtgtctatgatcggctgctaattcaattgaggccatgttggtctagagggatgtccactaggacatctcatggctcttatcctgcagcaggctggcccaggcttgttcatgtgacagtgggttctaggaggcacaagagagagggcaaacctcaatgcacaaacacttttcaggcctttgctcacttcacacccgataatgttccgccagcaaaagcaagtcatgtgaccaagcccagagtcagtgtgggagggcactatgatagggatgctgggatggggaagggggacttgtagccatttttgcaatcaaccactataatattgcttaatctggacccctgcccagtgagacatgccatgcacatattaattttatggagccatgcacatcccattttatgaggtaaagaatgttgccccgcgtcacatagcaagctggaaacaggactaggcttggaagcccatctctccagtgccagcccactgcaccatcccacttctcttggttccctcccaccccaacatcagtgccaggccagggagagaatgaagtgtcatccaggagccaaaccctggccacctgtacagacatccagcaacagagacatagcagaccctgggtgaaccctccccagacatcagcctccaggagccaatgctgcagccccactgccactgtagcccccaccctggcccagcacagagtggcaggctggttatttcaatcaacggtgttttgaaaatcttgcaatttaaaaccttttaaacatgagtaggtgaggctgtgatagtgccaatgactagttgggagtacttagaggcaattttaaatgtctcctgaaatctccatgccaacggtcccatggggcaccagacaaggttcacgttgccaggctcaccctcctgttagccatttcccctgccgctgcataccctgagggcttggagttccatgcacaagtgcatccacctttaaacacctcatgcagattatttctgtctcacctgcacctgccttcatgtcaggatttgcagaagcctaaagatcagagccaggggccaggcacaatggctcatacctgtaatcccagcactttgggaggtcgaagtgggcagatcacttgaggtcagaagtttgagaccagcctgggcaacatgatgaaattccatctctgctaaaaatacaaaaattagccaagcatggtggcaagcacctgtaatcccagctgcttgagaggctgaggcaggagaatcacttgaacctgggaggcagaggttgcagtgagctgaggtcacaccactgcgctccaacctgggtgacagagtgagactccatctcaaaaaaataaaaataaaaaaaatttaaaaaggccaggcgtggtgactcacacctgtaatcccagcactttgggaggccgaggcaggtggatcacctgaggtcaggagttcgagacaagcctggccaacatggtgaaaccccgtgtctactaaaaacacaaaaaattagctgggcttggtgtggggtgcctgtaatcccagctacttgggaggctgaggcaggagaattgcttgaacccaggagatggagtttgcagtgagctgagattgcaccattgcactccagcccgggcaacaagagcgcaactccatctcgattaattaattaaattaatcagagccaggagatctgtgaggcccatgggaccagtctggctgtgggtgaagtacccaggaggcagtaccctgctctcctggctggatccccactttccacacacccgagcctcagggaactccacccaggcacgtgggcatccatcagctcgtccatcacatccgcctgtcgtccttcccagtaatgcctgacagcaaagaatgagagcagattggagtctttgcagtgacaaacgcaggacgattcttcccacaaaaggggcccagaggcagagcaccagcctgagctgtgctgcaggagggccaggagggatgactgcctgaagcataaagatctggagaggaaggtctgcacacctggagttttgctgtcctaacgcttctcagccggggcccagaactgtgtgcagaagcgatggtctatggacaattcacctgcccctcggatagcaccacccactttgcattcggatgtttgaacacagcctgtgtttcccacagtggtcaggtggaatcctggactttcaggccagatgatttgtacaacctcctccttctacaaaaagaggatgatgggggccaggacatgaactccatgacacagacagctatggccagagcagggagaattaaggagcaggagacgccttggataggaaggactaagtgtgctgctacctggagagaggagagctgtgcattcaggcccagccttgtcagggaagcctcaagtctctgtttattaaggctggagggaaccagccatcctggctgcagtggtggagtgaaagcagccgagccctctgcactactgaaaattgacacagggtagggtctcccacacccctcctcacaggcacggggctgcagcccagctggtggggtcaagagaagggaggagagaggcctccggatggtgcagatgagcagggcggggctgaaaactgcatccattcatgccgctgactctaagcaagtagtgacgtcccccgggggttttggcagcaccaaggatcgtgcagggtgcttccacacttgctcctctcataaccctggagggagcatcccactttccaggtgagaagcccagggtttatgggtgggctttccccagttgcacgggaggccttaaaacaggtgaagaccctaaggaccgacggggagccaggcgggggaccaaggcgaagcagggtgaggcagaggtgttacagcatccatggcaggccaggggccaggttatgatcacactggagagacaggtgggagtgacccagaagttgctggggtcatttctcaaagaccccagcccactcatctccaccaacctgcaatttctcagctccacactgcaacccaaagagtggacagacaaggttgctgtggaaaaaagacttacacacagcaacatcaggatgccccagacagggtgcgtgggagtgtgaagctgtgcagtttaggcaggggcatggaggggatgccgggatgcacaagggacagaattgtgtgggatcgtgtagccttcatggaggaagaggacaagcagggccagaaatgatgaggacatttctgtcctcatgtatctggggagaaggaagcatattgtcttttttttttttctttttttgagacagagtctcactctgtctcccaggctggagtgcagtggtgcaatcacagctctctgcagcctccaactcttggtctcaagcgatccagccttctgagcagctgggaatacaggtgcatgccaccacacacagctaattttttattttttgttgtgatggggtctcactatgttgcccaggctggtctcaagctcctgggctcaagtgatcctccagcctcagcctcccaaagtgttgggattacaggcataatcaaccacacccagctcatatcatctttttattaaaataaggtaatgacttggacattagagctgtcactccccacttcaggccaggcgcttgtgtctgatctcactaggatcctaaagtgtatggtctgtaaattacaaactgcagcaacaaaatgcttaatcattaaaccaaggcagccactatgcaccagcctccagctgggtgctaagcgtgagtggccccagcctggggaagcctcactgttcctggtctgctgtgagctcctaggttcttgagactcaggtgttaaccttgcctgttttctcatcccctgcaggcaccggccgtagctacaccacagacccactcttgtccctgctcctgttagctctgcataagttcctgcgcctgctcttgggacattga

SEQ ID NO: 17 - DNA, 46032 bp, Homo sapiens
gtccccgcccctctggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacaggtgagcgggggcggcgcgcaggcccttcccgggcaaggcggggttgccgggcagctgcagagggggaactggggtgggaggcggtcgtggatctttgcgcgacaaagcttggcggggaggggacagcagacgcgttggaggacaggtcaaggagtcaaaaaggtagggggatgggggaggctaggggatgggggagacgagacctgaaggagaattagggagcggcgagcttgtggggactgagagaagaatgggggccagcagcgagacctaaagggaggggacaggaaaggggacctggataagaattagggctgggaagggtaagaggagagggaggctgggaggggaatcgccagggttagggaagaccctgagaggtaccagagaatgaggagtttgcagaattgggaagaagactggggtctgtgagagggagatgggtggtggttgtggagccagggtagggcaagtcctgccagagctgagaagaggtaatgcctgcaaagccagaggggaggtggccgcggtcccgcaggagctgggaagctagctagcggggtctagagagctgaatccgggaggaacctgaaggactcttccccaccccctagcagctctgagctccagccagtcagagggggttggtatggcctcccccaagatgtctctgcagacgtccctggagacaggagggcttttatcccatgcatttgctcatggccagagccccttcgtgcaggaaatagcccgtgctcccattgtaaagagcagcagaaggggtctggggaagcagtttggaaggatttccctgcataggctgtgacctccaggatgcatttccaaagtacagaatgcagaatgttctctggagaaccaggaggcaaagagtcctgctagagtgatttgaggaaggatggccctggggcaggggcatgacttaaaggacctcctaaaggccctctagatcccttatagactgtatggttccaggagtggcactaaaatgctgtgactccatcttcctttttccaatcaataattcaaaagctcagaggacccagttgtgtggggcctgtgtcagtcactgtacagtgagagtggaaaggaaatggctgctgtccttgaggcacttataatccaagaacagtgacattgacagtggctaaataggagccggctgcacagcagaatgtgggacttgggacgatctggaaaaggggaatagtgggctttccactggccaggtgttgggagtccttctccacaagtcgtggtcggccgcctctcaaccttctttcctgcccaacacacttgaggaacagccactcttctgcctttcagtgatgtctctccaggcaccgccccctccccttcctagagagaaccactgggaaactagttggtgtaaatgacctctagggtctcttccaactctttgtcttattgatgaccagtagcccacagaacggctgatcatctgttaaagaaaaaccaggttgtgtctctcccctgcttcaaatcctccacaacttctcactgagcttggaagaggtcatagcaaaccatgacatagcatacactgtgtgccaggcgcactgttcagagtacactaattaatgtgtttcttgacccagtgagggagccatagaatgatcctaacttaaagatgaggaaactgaggcttagagaaggtaactgacttgcctagagctgcacagctagagaagttttagagccagactctagctgagcttgtctgattctggtggccacactattagccactcctctccacccactcacctgctttaacatggaaggtgcctgcctctccagccaagctcatgccagtttctttcttcatcagcagtcttggcttccctggatttacgatcattcttttaaaacaccaagcccttttctgccccttcatttttctctggcctttcatacaaatggctccttctcatccttcaggtctttttccatttaaagtctcagggaggattttgcctactgacacataaaacaaaacaccctcttcctgttattctctcccatattgtttctaacaaatccttttatggcactctttacattaggatgcaatctttcatattcacttactggtgtataatatttattcccagcaccctctcagtgcctggaaagtagtaggtgtccaataagaaattgtagatgaataaagtcatctcaggggtcatccaatggggattatcatcttcaaatactggtgcatgcaccatgtctttgtaaccatgtgcaagctcaataggggcacaataaatatttgttgatacatgatacctgcccatccacattcccttacctggttccctcagtgacaaagatgtgggcaacttggggctgaatctatgggtgtgaatgtgttgaagctgagatctcacaatgacttggttgctgttgttctcagattcattcagccactggcccagatgaagtaaatagagaaaagacaaccaattgacatttcaaagcaagtaaagagggtggcaaccattagcggtgacagatgacaggagggtgatgtacatggcacctattgacaagtaggacaagagccagggaagctctctgaggatgttccttgaggaaagaaggtatggaggctggaaaataggggtctagatgactgtaatcacaacagaggtgtccaaggcctaatagccagtgtctctgtaactcactagttttggctgctgaaaaaattctttgggtttggaggctattcctagaaatctgatttctgaccctgaatggctggatgaagttgaagtttgtagtgattttgaaaagaaatttggagttttcccaggagttttgtttattttttacataaggtctgactccatcacacaggctggagtgcagtggtgtgatcacggctcactgaagtcttgacttcctgggctcaggtgatcctcccacctcagcctcccatgtagctgggaatacaggcacgtgccaccacgcctgactaattttttttatgttttgtagagacaaggctcaccatgttgcctaggctggtctcaaactcctgggttcaagcaatttgcctgcctcagcctctcaaactgttagggttacaggcatgaaccactgtgctttgcccccaggggttcttaatctgggtccacaaacctcccaccaaagggtctgtagatagcattaaaaggtttgtggtcttggataggaaaaaaatgacatcattattttcacttacctctaactgaagcagtattttctgtaattaggaatagcaacaaaaaccatagcgtatcatccatacctgtgactttgtccccaagggaaatcacagatagcttggtagcacattacagctgttgcagatggttcacattagatttacactcatctctcattctaaattatggtacttattaaatctcctgctagactctgttatttaatgaattaataaagaagcaaacatatagctacttcacaatttggttttattagacagtgctttgcagccctttgtcttttattttctgctttttccaacaattcagaggaagtgtccctaggcagccctcggccattcattacctctcatgcttccagctgttttcaagtcacagttctttgcttttctgaaatatacactctggaccctttatcctgccttcttagacagtgcctcactcttaatgtgcagcccttccaggtatgcaaggaattcagttttactacgccgcccactcctggcctggcaggtcacctgggacctctctgtcatcagcctacctctagaagcttgattattaggcagtgacctggcagcttgagcaaggagaaagagccagggaggcaaagcgagaatgatggtttctccttcaccattacttctgaatctattagtgagcggcggccagacccatgggttcctgcctctgaatttcctcatcacccttgtctgcacaggctgccactcagcccacttctgggacctttcatagaaagtcctcctttcgcccaacctaaagaattgggagtaagaaaggagaactgctcttttccccttgccccacggctcagtcctgtacccctaccatttggcaggcacccgcctcctgttttcagaaagccttctttttcatggcctagttttctcccaacacagtgtttaccttgctgtgcacttaagtgagtcttttcaaatgccagagaggtcccctgggtgaccccagtgctgtacctttgaagctaacacatggccaaaggctttattgaaattgcttggccctcagcaggagttcccacaccaattttttttttttttttttgaggcagagtctcactctgtcgcccaggatggagtacagtggcatgatctcggctcactgcaacctccacctcctgggctcaagtgattctcctgcctcagcctcctgagtagctgagattataggtgtgcaccacaacgcctagcaatttttttgtatttttggtagaggtgaggctttgccatgttggctaggctggtctcaaattcctgagctcatgtcatcttcccacctcggcctcccaaagtgctggggttacaggtgtgagccactgcgtctggcccccaggccccttctgtccatatccccagccacccactgtcacatgtgatcaaactctacaatcccatcctctttccagcagagtcgggatcactgaagtggctttcagtggaactctagtagattagttctaaggttttacaaaataatataaataagtgctgaatttctttctttctttttttttttgagacagagtcttgctctgtcatccagaatggagtgcaatggtgcaatctcagctgactgcaacctctgcctcctgggttcaagcaattctcttgcctcagccttccaagtagctgggattacaggcacctaccaccatgcccggctaatcttttgtatttttagtagagatggggtttcaccatgttggccaggctggtctcaaactcctgacctcaggtgatccgcccatctcggtctctcaaaatgctaggattacaggcgtgagccagccctcatggcctgaatttctatcaaacaatatatgtgtagtggagccttctccttaagatcagagaatttttccttcattttccttgtattcttgacaatgtctggtatggtgctgagcacatggcagtgttttgaattaaatcattatcttgtaacctaacactgaataagagagggaagacacaaaggagtgcatactgttagggctccactgacacaggatttgaagccagcacagtttatttatggtgttaccctgggggacaggaaatgactgcagcgggtaggagagcttctgggctttgttcatgctctgcctcttgacgtgggtgctggttacagaggtgtgtttactttgtgaagatgcatccagctctacatttatgatttatgtacttttctgtctgcagttatacgtcagtaaggtttttattaaaaagtgtcatattgtgacatgtttgtgaacattaattgagtaccaggccagtatttttttattgccaggaggactttggggccatattcaagagacatgagcctcctttttgtgttttttttaataaattgcttcttcggccctgtttgctttctgctgtttctcccatggccacctcctgtgtgctgcataaaggattccccctggggattgggacgttaagaccatcagtgtggtcctattaggcctcctacctcttctcctcttccttagtcctctagagcaacgccttctctgattgtttcttttaattcacacatgtaagagtgaggatggacagatgctgcatttcattagttaaatagttcattcatcaaagattaatgagcacatgctaggccttgggatatggcaatggaaagacagacatatgcttttcttgataaatggggagacagacaataaaacaagcaattgccatgatcagggaagcacagggtgccatgggaaacccagggtgggggatattacttccgtcttcagcctaaagtagaattttctccagtgcaggttgttttttctcctgaagtctcccctgtaccttaatgatgataggacgccccatgaattgctaaccccactcctggaactgattcaactctggaaggctgtaaggtctgacctccatggattctcagacttttacaggactcattttctagcttactattagctcatctcttgcctggtgaactcacccattcatataaaccaccaccaccacaatgaagtatttccatacagtaataaataatagtgatagaatagctaacatttatcaagttctttatatgtgccaatcactgttctaagcattttaaccatattaaaatgttttttgagacacagtctcactttgccacccaggctggagtgcagtggcgtggtcatggctcactgctgcctcgatcttctgagctcaagtgatcctcccacctcagcctcccaagtagctgggaatacagtcatgtgccaccgtacctggctaatttcttttaaatttattttttgtagagagggtctcactatgttgcccaggctggtcttgcactcttgggctcaggccatcctcctgacttgtcctcctaaagtgctagaattacaggtgtgatccactgcacatggccataaccatattaattttaattatcacaatagccctatgaaatatgcataattattatttttcattttgcagaagaaaagtaaaacacagaaagcttaagtaacatattcagtgggagagctgggaatcaaatttacaaaatttggcttcagagcccacacttttgacgactaggttgaagattagcagaaaaaagtagtcaaaattttatttgagccattgtgtttccccagatatggcataaaagtgtctataaatacacatctttgtaggtcaacttcagaaacctttcccaatgctttcgattgctttgctgccgccatcacacttcaggcattgggtgcagcccagggccctccacagaaattttacacagtaaacatgtttgggctggttgcttagcaacgtggaagacagtatgaatttttcatcaagaaattagcatagattctttcagggagatgagcacatacccgctggaaatactcttcaaagcactcacatgtggacccctaagcctgtgtccctcagtcttttttccagtgacaggtctgacctgtcccatctcccttcctcccctagttccttctttgggtacagtttgtagataattcagatacatggctcttctcttcatggaattgatgattcactagcaccttttgttaattctagcagaaaacagtgctgcatcctttccagattttcagatactagtcaagttgtgaggaggtacctggggcacaggaggagggatagagaggccattggatcatgacgaaggaaacacctgaaagacaaaccagagggggcccaagcaaaggcagaaggaagagaagagaccagcaggagagggaagcatcagacccagaagacaaagaggagaaaaaataagacacaaccattccaggatcaaagacctacgagagcaatccgaatatgtggagacagtccctttgttgtccacactgacctacaatctcccaataaccagcagcagttcacctcccgcttccaccttcttcttactgtattcagtactcccagggcttatttcttgctaagaaacaaagggaaaatctgctctgaggatggaggagaatagcttcatagaagcaagttttaagaactaagagattctatacgtatgtatcagaatcaacacacgtgcacacaaagggtcccctataactaatttgataagaaataatggaactaatagagttataaaggaaaacaggtgaaaaaggtgggttcctccctctttcttccttggttgtgtttattgaataactgtgtgccaggtactgtgctaggaagtgaggatacagtggtaactaccctcttcccaatgacacagtgacccatcttcagctctcacaaagcttatggtataatggggcaaaccagagtttatagaagaagagggcaaataaatgaaaatgtgtgctggtggtaggtaacctgaacagaaggttctgttgctttgtaagtgtaagatgaagagcttttacaagagtaccttacaagatgaaagctttcctaaagagtgatggccaaactgcgagctagagttggagaagatcttaaccagggcaaaagggaaggatgttgggggctccacacagagaaatgagcctgtgcaaaggtcctgtggcaggaggaagcctaacatttacgagggcctggggaaaagccagtgtggctgaagagtagagagaaagggagatcctggtgaacaatgaggctggggaaataggaaggggcctggatgagcagggcattgtagaccatagacagatttatttattcatgcattcataaatcaaacatttattaatgtctccaggaggggcattgagctacgtactgataaggtgaaggttaccattattttcaaagctttttttattcaggtgaaattcacatgacattaatcactttaaagtgtaggatcaatgccatttagtatattcacattgttgtgcagccactacctccacctagttctaaaacattttcctcacctcagaagaaaacccctcatccattaaacagtcactattccgccctcctccaatctgttttttgtctttatggatttgcctattctggacactgcatataaataaaatcatatgatatgtggtcttttgtgactggcttctttcacttagcatcatgttttcaaggttcatccacatcatagaatgtatcagtactttattttttatggctgaaaaatattctgttgtatgggtacatggcattttgtttatccattcacccattgatggacatttggattggttctaccttttggccattgtgaatagtactgctaagtacattcctgtagaaatatttgagtaactgttttcaattctttcaagtatatacctaggagtgagattgctgggtcatatggtaattctatatttaacattttgaggaatcgctaaactgctttccacaacaactgcaccattttaatctccaccagcaatgtatgacagttcccatttctccacctccttgctagcagttggtattttaatttttatttattttatttattttttttttttaaaaagtcatcctactgggtgcaaagtagtatctctttgcggtattttctgagcttttaatatctaaaaaaaaaccccaaattctcacttttaaaatattcatcagtagctggcaagtttttttaaaaaaatttttattataagttctgggatacatgtgcagaacgtgcaggtttgttacatagatatacatgtgccatgatggtttgctgcactcatcaacctgtcatctaccttgggtatttctcctaatgctatccctcccctagtcccccacccactgacaggtcccggtgtgtaatgttcctctctctgtgtccatgtgttctcattgttcaactctcacttatgagtgagaacatgtggtgtttggttttcagttcctgtgttagtttgctgagaatgatagtttccagcttcatccatatccctgcaaaggacatgaactcatccttttttatggctacatagtattccatggtgtatatgtgccacatattctttattcagtctatcattgctgagcattgggttggttccaagtctttgctactgtgaacagtgctgcaataaacatacatgtacacgtgtctttatagaagaatgatttacaatcctttgggtatatatccaaaaaccacagtagctggcgagttttcaacaaacatttgctgtctgtattgagcaactattaaaatgagtccacatgggcaacccgtaaaaacatttcattgttcatgagtctcgtgagaggaatggagtgtgtgtgcagtagtcctggctgccctgttcttccagcaagtttgcacctgctgctctgtctgtcaaatatgttattattgtcatctttcccattctgttcccccaagctttagcccctcatgggtcccactaaaattccccccaatacccaggccctgcaaaccccatctaattgaggcagtatttagggtctttcaatatttccttaccaggccagtgtgatgcctggaggagccttgcccctctccagggccagttgctgcccacacaatgaaccttcaggaggagttcaataagtcccaattcattagataaagggtgctgtaattgccttatgttatagaaaagtcctgggagatttttacacactgcttaagaatgttacaatgatatttggggaagttgattgtggttttggggtagacttggaatgcattataatttttcccttaaaataatggagtaccagtgcctgctttctgaaatctgctaatcaccatgtttttaggaacagatcagagtcaaataatgagggggagttgcatatatgaatatgaatgaaaacaagcgtaaaggagagaggggtcctgtgagaattctgcgaaattgagtcagtccatctggcatagaccctagaatattttgacatatttcattgattcctctccctatccccacctccactcattaagtccaagacatgctttttctgtcacagaaagttgagcaggacttagcacatggcaaagagaagtgaggagacatgttgaatgactgaatacattgatgaatggatgggtagacaaatgaggaggtagggatctgtggggctgccacctctgcttgtagccaaaatgaaaaccacaggcacagagaagcaggggagggtgctgagtccaccgaaggatctctatgcttgcctttagtgatatatcaagaaatcaagaccagcaggaagcatgtggcaacttcactttttacaggtttctctcctttcaggtctctgttcatctggctaacgttagagagagttttttaaatcttcacctgcaaggccaatgaggtaatacccagggagatgttttatttggaagagcattataaaccacacaggttggactctctggtaagaacagcacgatgtaaaggctgtaggtttattgaggcaggattgcaaagactttgcttttcaaatagaattaagaaggatgttttggaaaagatggtgtttgaagatgcagataaggttgggtaaaagcggtttggtaaggcaactggaagagttgattgaaacagctgcaagtgtagaatatcttctgttagctttaagcttattctgcatttctgaatgccccctgcaccctgcttctcagagcatatcgcggagcatcttaaaatacactttgatttccagcacagtcacttcacatagaggaaaggggaagctatcagagaggaatacagtgaaggcagtgatgtgacatgaggagaaaatattcacatgatttggagggtttctttgcacattctttgcaatgcatcatctaatgatctcgtctcttacttactaacaaatggagcagattctttaagtggcaacatgactatcaccctttgcaaaacagcctccatacaaaacacatagagacaaagaacagaaaggaatgaacgtgaggttaggtgcctagcctaatcccaccacattgtagccttgcatttgatttttgggtacccattggagttaattttaggtaacaatctttgagactactcgaaagaaaaaattaactcagaatgaaaatgttcacttttataatcaagatgctgagctaaaatgggaatcaaatgagactcaaaaacctgaatttgaattcagactccaccatctcctagccaaatcaccacagccattctgaatcccactttgctcattcatgaaacagggattctacaaggttctctaaggttatatggaagaatgaatgagatgacacgtatgaaagcacccaacggattcagcacttgcctttgatcaaaggatatttttaagaatctgttaattattttcttatttatcctttaccaaagcaatgacttgtctattcaccatgcgggaaagaaaaaattcattaacagtattccagacgtgataaatgaaacgtgtctgttagaatgaaaaggggaacatgaacattccacttctaggatgattattcattcaataaatatgtcttgcatacctgctatgtgcaaggcactgagttagtcctcgggacagtgcagtgacaaggcagaacccatccctgacctcatgtcgttaatattctagagggagagatgttcatcacacagttatacacagaatgtagtaagtgctagaagtcatctccttgtgcctccagaaccccctaaatgctcccccgtcaaccccaaacctacttcttccccaccccctgctccaagcctatccccattttctccccctccacaccctggccccagaaggcccccacctatcagctgcattgaccaactcctctgccttttggcatcaggtggagttggcccaaaggagatctgaggacaagaggagtgtgaggggccttcatcacccctgctccctccctgctaggtgcctgggggctggctacatcctcagctgaaaggctcagatcctgtcaggccactgtctcccttcggcaccctgtcctgtttccagtgacctctcctgcttcttgccccttcaggcctagggatggtaagagtgcccagctctcccagtccctacatactcgccattccttgttgctttccttaaccctccatacatttgtaaatacctgctttatgaaactctcctcaattacccagttataatgtgccatctcttcctgcaaaaacccttattgatagcatactcaaaccatgttagctattattaccaaccctaatgattaataataataaaggaagagtctgtgagtcagaggaagtgtgccaatgaaattggcaaaactcaggaccaacagtgataacaccctctatttgcacaaggttctattgttcagaagccactttcgttttcccatttgattcagcatctagcctgatgctttgtgcgtcttgaagcctttaatatctgcttgccaaacagacacacctgcaggtaggaagctctggggctgttattctcatttcaaaaagcctggagtgagctgaggaaaaatagttctcatttatagtaatttggagccaggtactctgatatcactgaccttccatgatcaaatcatattttgggacattttgtagactgtttgattgtcagcccatgtaacacagaaggaaatctattaggtttgcatctcatttaaaagaaggaacagctagatctatggatgatactgactggctttgaatctgccaaaatgtcagctggtggaagaatgttagaagcagcaccttaatggccatcccttgaaatctgcttcctgactagtcatgaaattcacacagaagaatcactttgtcgcccaaacatggcagagactgcagacatccagtgacacacaggggttctgcttttttctttctttctttctttcttgttatactttaatttctgggatacatgcgcaggacatgcaggtttgttacataggtatacacatgccacagtggtttgctgcacccatcaactcatcacctatattagatatttctcctaatgctatccctccccaaccaccccacccctgacagaccctggtgtgtgatgttcccctccctgtgtccatgtgttctcattgttcaacttccacttatgggtgagaacatgcagtgcttggttttctgttcttgtgttagtttgctgagaatgatggttcccagcttcatccacgtccctgcaaaggacatgatctcattccttttttatggctgcatagtattccatgctgtatatgtgccacatattctttattcagtctaccattcatgggcacttgggttgattccaagtctttgctattgtgaacagtgctgcaataaacatacatgtgcaggtgtcttttttggaaagggaagcctgagaagttatagttgaagtgtatttttcttgaggcagctctcactcttggattcctccctttccccagcacatggttcccccaacctgggttaccctcactgtgtctctgtgtctccaggttggttttctcacctagtttcctccacatccgtccatccctcctgtatgaacctgctggtttcatttactgaaaacactgttttgctcatgtcattctcctactcacaaactgtcaacgtttctccattgtttataagatagaattcaagatttttttgcttggcattcaaggccctttatgacctagcctcaccattcctttccaactccatttctccaaccccagccttcctctccagctgactcaccatgtcctaagcatgctcccctctggatgcacactgctgctgtcctcccaatttgagatgcctctctctctctctcattgttaatcatccttgaatgctgcattgaagcccctcgtccaggaagccttctctgatcacatcaacaatgaagagttcctccttaggtcttatgtagcctacagtccaggtatttggctttttaagactgtcttctatttttatctatcttttcataagtttgaatcagaaatagcaaatgtctttcatcttccatatcaattcctattaatggatagtagcttcctggagccctaagctgaacaaacaccctgtgtctgagctcagcaggaaagaatgcttcgatcaattagctgaatctgccttgagcacagggtaggagaattgtagcataagcacctagtatctcccctttatggaatatctcatctctaccatgggatggtaaactctctgagggtggggacttactcctgtgtctcccatggtatgtagggtgggtgaacaggtgattggcaggcaacaagtatgttctgatttctgtttgacagcaatataatgtggagcggtttgacttaaaaccaatatataaggagaatctagttaaaacagcctctgtcttggttttgaaattgcactttatatctcggctgttttttcaacttccaggttagagattgatgtgcttttcaagtgctgcatataagtggatggatgtcttagattagtggttccctgcactttttttctacactgcatcacctctaatgggtgatagtcacatgggtttgatggttttgtagatttacctcctttctcttccatgaagaaaagcttatcaaaatgcaaaagtgtgaaagaggtcttattataaggataaccttgaatatatgttaatcaatttttaaatgggtacaaactcaaatttttgtactttattatttataatatattggcacaataatggttatagcagttggcctagttaatggtttcatcaattgcctgaacaccatagaatcatgtaatcctatagcttctctgaaagaacaccctaatttcaatgccaaggaaactgacataaaaacaaacttttcagcctttaatacaaaagtgactgtcttgggaaaagaacattaaattagaaacacaaattagaaactaagaaaaaaaagtctaaaggattcaaatgaaccaatattaaacaattgtgttcctatctgacagaagttttcaattatgcagagctgagatgcttctatacacagactcagtttaacaggaaaaatgtgagcccctagtaaaccagtacagtgggacaggagagggggcagaagtggaaattttggaaagcaaactcaaattttgggagtcacagagaccatgctctgaggtgaaacacattgctgacagccttgttgtggccactggagatgggaaaataagggtagggtggctggagtgaaaaggctgtgttcaagtccagattactgaccttttaaaatacatcagtttatgagtgttgatgagattacaacatggtcttgacattgcctttgttcagggcacaaatgaaacacatttcccacacaaagaatgttttgacatctaatgatgtgacacctgccagaaaagcaaaaacaatgattcaaacttttccattttcaactgtgtagttgttatccagagacacaaccccaagaaaccacagacagtatagtatacaggttagtagcactagctttggggtggacaaaggttcaaagcccaatgttttcatatattagctatgtgagcttggatatgtttcaatctctctgagcctcagtttcctcctctgtagtaaaaataattaggttattttttatttgttaatattagggtatatagaatagagaaaatattaggcacttatctatagttgcgtgaagattaaatacaataaagtttgtgttgtgcattgcagagcatctgttacatatgaagtttacagaggtggtggccaaagggctttgtgatgtgactgctgaaataatgcaggggccacctacaagaaggaaatctctaggtaggatcttgccatcttggggtttccagtcccacggagttttttgtttgtttgtttgtttgttttgtttttttgtttgtttttttaataattgttttaaaatttagtttccgccagaaatgttgggattgcagcaacattcaccctcctcctctcattgggttttagctgtattgcacctgcggactgactgtactctggacacagtgcaaactttccttctgccatcttggcggaatgcccctctccaatttctctacctgtcagacttcagggtgcccaacccaaagtcagcgtctctatgaaacctcctgcagctctcccttcttcccttccttctcctaccaccctccccttctccaggtaaagcttggtttgcttctacagactctgcctggtgttttactgttctccatcatagttattactctaataatccccctcctccccactccctgcaaccagcacacatacagactgtgcgtcggggtagcaatcagtgttggccatgccttttatcccataaaaggctcttaatgttgaatgatgattgatggagtgaatgagtgaatggctaggctaggagggtagagatgggacatccttcctccagccccactggcttctccttatatctactcaagacctgggaatgacaacagaccattgtgtcttcccaggaagggaaggatggggccaagctggaaagcctgtgggctccacagtcatgtgcctgggttcaattcccagttctgcatcttattaaccatgtgacttcagacttaacccttctgtgcctcagtttcttcctctaagtggggatgacagtaatgcctcctcatgaggctgtgaagtttaaatgaaaccgaatgggtaaaatgctcagacttgtatctgatacatggtaaagctgcatatgatgggttttctttttcttcaaattttagctcagggacttttccctgaccctcaaattcttagtagaaacaactcctgcgccccacccccaccccccaccactcaaccgacctcattaccatctgtcccggtctcgacagcacttattcctaagggaaatagctttttgggtcccctggcttcttgctgtctaccccactggaaatgtccactccataaggacagtgatcagacagtgttgttcgggcagttggccattgttgagaggtttaatcattgttgaatgacaaacagcagataaaacgtttgcgttagggctggctggtattcctgttgtgtctcatcctggccgggttgggaggggcagctgccagcagggcttacccaccaacaaatctccaagtcggtcacatcaagtaccggctggaggcagtgagtgccctgggccaaccacaaatgggcttttttagatttcaaaataatcacaagggaaaaggagaataggaggaggtgagctacgagggaggcggatttgagaaaggattgggggcacagactcggaacaaacaggagaggaggtgttggaagggataacaaaagatggtacaagggtaatgtcgccatggaaacactgcgccgcctggactggaagccaagcctcctcttcaaggtggatttcccctttgcagagtgaactgtgtcacctctctcccactcccagaaataactgtggatttgcctaagggcacatggcttcacaattcttcaagcaggcaagacgtagaggaccctggtgctggcagcttcctaggagatggaggcctagcaggcaaatcagtgttgccggggggagctgagcggactctgagacaggaggccgtgcctgtgagcagcttaacatgagagagggggtgtctacctctaccctacctggatgtttggggctcccccaaatcagggtgttcccaagcaaggcgtccttaggctccacctagaacccaccaagtcaaacctctggggggcctgggaatctgaactgtgcactccccaaatgaagctgatgcacgtcaaagtgtgggaattggcgctgacagtcccgtttccctgactgatgggcatgaaggggcagcatagtgggtggtgggaccaggcagcgtcctgggcatccgccttaggggcacagaaacgtggaggaatggtcaaggctcactagaaatgggaggcggtggctgaagtggcgggaaggcagcagggcctggtggttccgcaggggattctggggcgagtcagcctgggtctgaatgcaccctctaccgccccctagcgggccaagacttttggcacagaactgaactctacggactcagtgtcctcgtctgtaaaatgaagttgacaatatttgtacttcctataaggttattatgaggatttaagaagtttatgtttgaacagtgcagggcacaggtaaacaaggccacaaggtggaagaggctgggaccctaagtttgaaaataaacggcccttttcagactgtgagaaatcaacttttattgtgttcagccttgaggtttagcagttggccttccttgatgaatacaagtctgttaataagtgactggctagccatgaaggttcagttagttgtcagtatctgctaggacacaattggttgggtgtgccttcctctacagaaggaatgggcacagatcaaacctttggactggttaagagctgtgccccacattttctccaggaaaattttctctgcagttggaagtgaaattttgataaacttctaagctatcttcaaaggatagcgaggctgttcccactcagcctctaggagttggtccttctctggaggcaaaatgagcaaaatgaggatctctctcagtttcttacagcttgatgtaatggacttaatgcctgttgtccagacattaggatgtgtgtatgtgtgtgtgtgtgtgtgtgtgtgtgtgtgtatttgagagggagtggaaggattatggtaccagacctagaagtcataaaataaacaaaagaaacttttccttgctggtagtaatttaaaacattttaatactaaaacaatcatatggaatcaaatacaaagactcatatgaatttgtaagatagaattggagatttggagaaagatccccaattgctcctgactgcttcctcttccctagagtacgtgtcagcttctgcctctgaggctatttggaaagaaagtttgagaaatactggtttagagaccagtggatcctaaatgtaggtccacagccaagttctgggctgattgtgtgcaggaatcactcagcaaacttgctgagcatacagattcttcaaccaccccagaaagcccaattcagcatgttactcagaggtgcatgtgtgtacaagtatctatctctctctctatttttattgtgatgtaatttgcatacagtgaaatatacacatcctaagtttacagcttaatgaattttgacaaatatgtatccctcaggctgtaacccatacccctcacatgcctcttcccagtccattctccccaaaagcagtcactgttctgatgtctattaccactgatgagttccacctgtcatagaacttcatctaaatcagggtttcccaacttcagccctaatgacattttgggttgataattctttgttgtgggggaattagggaacgaatgtgtgccctcgaattcatatgttggaattctcaccccaaaggctatgatattaggaagtgggccctttgaggggtgatcaggtcatgagggtaaagccctcatgatgggattagtgcccttgaagaagacatgtgagagagatgctgtctgctctcaaccatgtgaggatgcaacaaaatggctctctgcaaaccgggaagtgggctttccccagataccagattcaccagctcattgatcttggacttccagcctctagaactgtgagaaatgaacatttgttgtcgaagctacccagtttacggtaagttttatagctatccaaactgagataggggttgatgttgtggcatgcttagcagcattcctggcctccaggaacagctcccaacccccatggtgactgtggtcaatagcagctccactgcctccagttgtggcaaccaaaaatgtctccagacactgcaaatgtcgcctgagcggccaaattgtccctggctgagatccagcactgtcagtggaatcatgcagtatgtatgcgtagacagctgtcttcttttcctcagcatgttttggtaattcttctctattgttgagtgtacctgaaactcattccttttgttggtcgaggaatattccattgtaagaatatgccccaatggacttctccattgtcctgttggtggaaggctgggctgctttcagcgtttggctaggatgagtcacgttgctctcagtagccatgtctaagtcttcttgcagattcatgttttcctttctcttggataaatacgtgggagtggataaaaactgttgagtcatagggtagatttatgtttaacttttaagaaacttccagttttccaacgtggcttgccattttcccttccaccggcactagtgaccatcccaaatgtctcacatccttgtccacactagtgttgtcagtctttttgattttagccattttagtgggtgtgtagtggtgtctacattttttttaacatcttcctgggtaattctcacaaacagctgtattagttatctattgctgtgtaacaaactaccccaaaacacaatggcttaaaacaacaatgcttattatctcagtttctgtggggtcagaaatccagtcatggcttacctaggtcctttggctcagaatctctgccaggctgtggtcaaggtgtcctctggggctgtgctcatctcagggtttgactggggcaacctctacctccaagcttgctcttgtggttgttggcaggattcagttcttcctgcggtgccctcgggtctttgcacatggggctctctataggaaagctttcaacattgcagtgtgttttatcagagggagtgggtgagagagagcaaggaaaatggaatgtcatttttttggtaatctaatcttagaagcattgtcttctcacatttgcataatctgttcattcgaagcaagtcactaggtccagcccatactcaaggacaggggattatacaagggcgtggacaccaagggacgggacactgagaggtctcatcatagaggcacctaccatggtggctctgatgtgagaatgcttgatctagaccagagcttccccaaccatctgtgagagaggatccagtttagcttagtttagttttgttgtaatgctcacactcaatgtctatatttatcacaaatgagtaaaaaagtaacaacaacaaaaagtagttcatcaactggtccctacacacaaaccccactttttgtagcacctgactagaccctagggtcacataaatattgccgacatttgtcgagggttggctgggctagcctctgtcctaagagctctgcgtgagttatcttatctaagcctcaatccaaccccaggagatagatgctattgttagcatccccattttacagatgaagaaactgggcacagagaagttaattaatcagacccaaggtcacacagcaagtaattgacagagcccagactccaactaagctgtcttgttttagagcctgaatacctgaccagcaggatatatttcattatatacacgttagtgtgcataatcgccagtattagaggccagagcgacagactcttgcaggtccctttgccctggcctcactacccccttggcgggggcttagctatactatagaccccagcagcagcagtggcccatggttggcatcatctgaatactggatgctcaactggatgcttcttctctgccctccccttttttaaagttcaagtttaaggagcaaagatgacctctttttcagctggatctgcttcccccacctgcaacctcctgggtggtgcagtgctactgtaagagggatgtcccagcatgaaaccccaaattaataaacagccctaaggtgaaaaattaatcatgtcacaaaaggggtcacctagcatctttggtaaggttaaacgtttgtttacagatcattaactacataattaagttttggttttccaacataagccccataagggaaggacagcatctgtcctgtttactcccatattctgaacacttagcataggacctggcctgtagtggggctcagtaaatatttgttcattaatgaaggttcaggttccaccccccgtgccatctgtctctgcctggattattactggaggcagagccggaggcgtctgtgctacccttcatgaggaagcaggagccagggaatggtgggcagggcctgggaggagagaggacaagcacaggggcattactgagtcactgccacttggcatccagggtgactgctggatttccaggggtcatcttccaaaaggcgactgaaggcacttctgggaatagtgaggaggaggaaggagaattcattgcctgtcttcctgctcacagggctcgagttcctcccatggagatgtttggggttttttctctctttttttttattatggtaaaagaacataacataaaatttaccatcttcaccatttttaagtgtacagttcaatttgtgtgtgtgtgtgtgtgtgtgtgtgtgtgtgtgtgtgtgtgtgtgtgataggatctccctctttgcccaggctggagggcaacagtgcaatctcggctcactacagccttcacctcccgggttcaagtgatcctcccacctcggccgcctgagtagctgggactacaggcgtgcactaccatacccaaataatttttgtattttttgtagaaatggggtctcactatgttgtccatgcttgtctctatctcctgggctcaagccatccttctgcttcagcctcccaaagtactgagagtacaggcatgagccaccgcgcccagcctcagttcagtggtattaattcattcaggatgttgtacaaacatcaccaccatccatctccataacactttttgtgctgtaaaactaaaaatctatacccattgaataataacttcccattttcccctgccccagcctctggcatccaccattctactttctgtctctatgattttgaggactctaagtatttcatttgagtggaatcatacaatatgtgtctttttgtgactggttgatttcacttggcatcatgtcctcaaggatcatccatgttgtagcctgtgtcagaacattccttctttctatggcagaataatactccgttatatagatataccacattttgtttatttattcatctgttcatagatatttggattgcttcaccttttagtgattgtgaataatgctgcaatgaacatgggtgtaaatatcttcaaagaccctgctttcgaatattttgagtgtatacccagaagtggaattgctggatcatacagcaattttattctttttttttttttttgagacaaggtcttgctctgtcacctaggctggagtgcagtggcatgatcttggctcactgcaaccttcgcctcccgggttcaagcgattctcctgcctcagcctcccaagtagctgtgatacaggtgtgcaccacaaagcccgggctgatttttgtatttttggtagagatggggttttgccatgttggccaggctggtctggaactcctgacctcaagtaagtcacctgatttggcctcccaaagtgctgggattataggcatgagtcaccgtggctggctatttttctttccttttgttttcttttctttttttttttagacggagtctcgctctacacccaggctggagtgcagtggcgcgatctcagctcactgcaacctccgccttctgggttcacgccattcttctgccttagcctcccaagtagctgggattacaggcgcctgccaccatgtccagctaatttttgtgtgtgtgtgtttttagtagagacggggtttcaccgtgttagccaggatggtctcgatctcctgacctagtgatctacccgcctcagcttcccaaagtgctgggattacaggctatttttcattttttaagaaaatactatactgttttccacagcagtgatacattttacattcccaccagcagtgcacagaattccgatttcttcacatcctcaccaatgtttgttattttctgttttgttgatagtagccatcctaatgggtgtgaggtggtatctcactgtagttttaatggcatttctctggtgattagtgatgatgagcatcttttcatgtgcttattggccatttgcatatcttctttggagaagtgtctatttaaatcctttgctcattttgaatcaggttgtttgggtttttgttgctgagttcccctatggagctttaactctctgcacatctgggttgcttctgagtggacagagtgtccctggtgtctcataactcagcaggcatggagaagtcccagggcagaaggcaagaggggcatggcttgagcccagtgtgaggacctgtgttgctgtgcccatggacagctggttggacacagtggggggagcaagcagccaaaggtcccagggacaggtgaggcggagaatctaaggaggcatttgaggggtctgatgcacatctgagggtgtgattcttctatccagatgtgcatgcaatgccaagaacagctgtgcacccatcctctaattgttgaatgcctgtctccactggaaatcttccctcattcatcctgcagatatacttcccaggctctattcctgggcttcaagggacacgtagacagagaatatctgattctaagtcctgtccctcctgcacccatggtggaaggctggagcaaggtctctctctagggccctgctaccctgagcacctccttcccccagacattcttgttcttcacctagaaccctctcccaggctccctctctcaacccctgaacctattttctgtttctctggcactgaagtttcagctatttaagtgcaaatatagatgcatttgaaagatgtgatggaaccaggtttgaaatgcaataaataagattgcacaagagaaggagataggtaatcagctgctgcttttgctccttgaaaagactcatgtagctgtcatcagactctgctcttggcctgggcaaaggctgtaagtcattcccagctaaagccagccatttgccacacaggataaagtgggataagaataaacagcaaatgaggatgccttgggctggatgcagagattcaagagggtttctttctaccctaggcccagtttctctacaccagggtcatgatctcctgtgatgcttgaaaaaggcaatgcatcagtttgggatgctcttggctgcaaggcacaaaaatcccaattcaaactggcttaaacaataagaacagtactactcacgtaacttgaaatgcagaagcaagacagattgctggattggttggctgagcagcttaatgacattgccatcaaggacacaggttctttctgtctctccactctgctgccccaaggctgactcaccttgcagtcacaaggcagggccacccgcttcctgtccagggaggaggggacttctactactgtggaatccaagtccctcccttccatctgggttggtttccccaggactggtgccaacccctgggaatcagtcaccaagataatgccaagaaatggaaggatctgacctcttcctgggagctggggatgggatggaacctagacaacctggtgttgtgtagggcgggtagatgggagagggaatggatattggtagacaaccaagaaatgcccaatcttttgctctaggggtgcattttaagctctggtaacaagctcctgaggttatcagggacatacaaattgagatccactgaggagggaggaaggcagagccagagtgtcaagacttgaggcaacacagagtgaacttcattcagagctgagcccagtgattatttcccccttgaaaatgcaaattcatccaaattgcatcaaactgggaatgaagcccagcccttttctcagacgattgaattgggatgaaaccaaatataaacacaaaaatgtttcccagaccacccaaacagtcttagttctggtcccaaccaagtgacagtagagggtgactttaagtcaggtgtgtgctgaggcccagcagcctctgggaacgcttttgtgccgatgaatgggagggagtggcagtgggtgggcccctgagatgctgtgattgccatttagaatccagtggcaagaccgacagggattttgcagggggcaagggggtggtgttgagaagcagctgcagggcaatggaaatgacaagaaatttgaagtgaaaacatctggaggctggatgatacataccacttgtcagttgtatgatcgtgagcttccctgagcctcagtttcctcattgtgaaacagtaggatgaaggtaatacagagttatatgagatattgaaggtggaggtgactttgtgtagggtagaaagacggggacattagtcatcgctctgtgtgtctcctccaaggaccctgagcatctgctgtcagaagcacagacttttactcccccaagcccggtcttcgcctctgccttccaaatccccctctctttcaaggtctcagtcatgccctggctcctccctgaaggccagctcggcctcccaggcacccctgattgtgccctgcatgtactgtgcactggccatcatgtgttatttacacatactgcctcccgtctgcttctgtattgtggtccagagtggccaaatatacttatttatttcacctgtttgtgatcatccctaactcacctatacctgaaaataaagcaatggtgtctctcatctctttgcagcctaaaaaagcaactcagaatgtggagtgggatagcctgcaaatcacttgtcacttaaggtgacggcccagagaggtgaaatgacctgcccaaagtgacccagctccagcggcagggttggtactggaagccagcctccttgatgccagtgacactctcagtgggggtggaggtgcaaaggggacctgattttgtaaatcatacatgtccctcccagggtgactggttgctgtgtgtaacaagataatgataaatgtttttgatggggactgctgtgctggggaaagatttggaggcaggaaaaatgtcgaaagccatgggggcagtgggctttgggccaggctgatctaggcttactctgctgctgccctcaccagctgcatgattccaagtgacttcactccaccgaagtcagaaatgcttttagagcctatgcgtgccaggcacattcagtggtgatcaggctagaatcaggtcctcgcttgggttaccttataatctactgtgcagtgtttctgagagaagaactgagggtttcttatctctccgagcctcagtttccttatctgtacaagaggggtaagctctaccttttagggaagttcagaagaaaacacttggaaatgcaggggcaggaagtggttgtccaagaggtccccgagagtccggcccctgcttcctgcccctttgggccctgctgcagcttcttatccacatcccctctgtttgtccaatggatgaaactaattaaggaatgcccctgtcacctaggtccggtctccttcaggaatggttggggacagagtctcaaccagggcagaatgtccaggattcatcctgggataattaaataaagagggtacaaaaattagaaacacaactttttgaaatagtgtaaactgttaactgcctctcctgccagaccacgtccactccctcccctacacagtgcaggatcactgctgccactgggtagggcagcctgagtcctgctgccagccatctgcacccactactcgcttcagccatggagatgggagggccaggagggctagcatggagggcaggaggtttcttgggagactcagtcatagacctcagtcttcagatccgcctgtcttaacctgagggcttttttatgggctgcccacccagagtgccagcagtttaagctctagacctggccttcaatcctgaggaccaggaaggctcctattgctacctgtcatacaactttgagtctctcaaataggagggaaagacagaagatccctgtcaatgtctctgtagatgctgtgtgaggagccccatatacttaagggttgacaagcaggtgggtctttttgaaaagaaagattccctttcgttccaagcgaaaagggcctagcctagagcacacaattgggcaagtggtacacaggctacattttggcttctactctgtcctcatccagagatttttgtgcagtgcacaaaccattcaatatggcagccctagtcacaggtattgattgcatgctccctgtgagctgacaccatgctaggcacaagggacacagcaacttgatgcccagtgacactcttactgggggtggaggtgcaaagggaaattgattttgcaagtcatacatgtctctcctagggtgactagttgctgtgtgtaataagatgataaatatttccgatggggactgctctgctggggaaagatttgaaggcaggacaaacatcgagagccataggggcagtgggctttggaccaggctaatctaggcaggagcaagacaagacataattcctgtgctcatagatctcacatgctagtgggagagtcttaatacaaacaggccagcctatgaccaaaacaatatagggtgagattgatgctgtgaagcaaagagtgggatgtggtgatagggagggacaggcttgggggagggatttaatttagattgtaaggttagagatggactccttggttcagacttcaggtgtgagatggagccagccatgcaaaaacaggtggaggtaggggtggacagtttgggaggaaaagttaggggctggaagctggaccaaggaaagagcccaagctgtttgagaagcagggagctcagtgactggagatgagcaaaggaaggattgggggcgatatcagagagatgagcaggatcaagctaggcaagctgcaaggagtctggattttgtgtggtgggagccactggcatttctgagccattaggtggagaagaggagggaggaagggagaagggagaaggaagaggcaaggggagcagatgagagcagcagagtggggaccacctgcagcaggtccaggcaatatccatgggcgcagccataggatggatgggccgatggatggaggaggtatggatgaacaaggcccacatctcagtggattgtggatttgagtgggtttggagatgatgttagaccttcctaggttgtgctcttcagagcagaatgaaaccacaactctccctctgcatcctacaacaggtcagttcaccgtttctcccttccatggggggaaacagacaagagggctcctttgtggactaatcagagtaatttgtgtttgcagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtaggggtctcctgccccctgcacttccatgggcagcactccagtggggcttgtcaatgtctctgtagatgctgtgtgtggcctgatgaggaggccgagtgccccggcatttgacgctggccaagcagatgggcactgggcctcagaattatggtcctttcttcctgacaacatgttgccataccacttctcccccagaccgccaactttccactggaaaatggagtccctttctagtcatatgtgtgcaactatgagagaggataaagagccatggttaaaaccatgggcttcagagtcaagggtttaatttgctgccctttcatacacttattgtgtggcatgggtcatgctgtaactccatgaacctcggtttcttcatctataaaatgagactagactattatctgtctggtaggggagttgtaaagtgtagataaaataacacacatagaatgcttaattcagagcctggcacaaaggaggtaacaaaaaacatattgggttttttgttgtttttttgagataaggtcccaggcacattttttttgagatggggtcttgctctgtctcccaggctggagttcagtggcatgatcgtgggccactgcagcctcaatctcccaggctccagtgatcctctcacctcggcctcctgagtacctaggactacaggtgcatgccaccatgcccagataatttttgcttattttttgtagacatgagatctcactatgtggcccaggctggtctcaaattcctgggctcaagtggtcttcttgccttggcctctcgaagtgctggggttacaggcatgagccaccatgccccgtcgaaacatattgttattatttctactctccttttcatcagcatccacatcaagagtgcagcacctttaggtgtactatgctgctgctgggcactggggaagatatgggaagaagagacatgatcgtccctgacccaaagaatatgtaggcgttttagaaagacaaaacataaagcagggagagtagattgttgtgtagtctctgttttgttttgtgtggttgatgagggagccagtggacacagatgcagcctaatgggctgtgacattgaccccacctgttgtcttggtgtggccactgtgattctgcacacagctgggaagacttgggtttgggttcctggcataggtgatagagatgagaaaggtgtaatcaggaaagcagaaccccagtgtgggtggcagtgacgatttcgactttcttaacaggtgtggtggaggatgtctgtgtcatggagacctggaacccagagaaggctgccagttggaaccaggcccccaaactccactactgcctggactatgactgtcagaaggcagaattgtttgtgactcgcctggaaggtatggctcttatttgactctcgtgggcttctgtgtgtctatctcccctggagaagctgtgcaggcaggatgggatcatctgcagctggagagagcactggattaggactctaacaaccagaccctggaacacatggagcttagacacaaagatttcccacactcccaaccccaacagtccaaagtggggattcctggttgacaaacgttttttctccaaatggtgattcaaggaccagactccttccagctgtggctccataacccccctctccttgtcatttgtatccttgccatctgtatctggcagatggaaggagaaagagaaggagagggcgtaatcattccttaacagcctttacctggacttggtggacgtcacttccgcttgcatcccattggccgtagctcagtcacatgagcacactcaactgcaaagtgggctgggaaatgtgggccgacaggtgccccggaaggaaaggcaatgagtttggggtgaagaactagtcgtctctgccatagatgaatttgaaattggacagggctttgtgctggacacacagcatgttccgaatggtcagaaaagtttctacaatctaagagccaagcggcctgagggtggcaggatgtccttggtttctctgccctgacaattcactttaaggtcagcaactaaagctaagactttgcaaaggaatcagggctagcaatggggtcagataaattggaattttgtatataattctattttctgaggctttttccttgtattatcttttaagattttaaagcaccttcctcctatactttattatgtttggtcttcacactagcgcattttacagattaggaaactgaggtctggcaagtcatatgacttgtcaaagatcactgcatctaactggtgacagagccaggactaagcagtcccttgaagttcagtggaaagctcttgctgttaagacacatagcctcagttcttcatcttctcttcttgtgaaatgtcagctaccactttccaaacgatccctgaagagccagtcagaaaagtacccaaggtgtacatttctgggcagagccacacattgtgaagcattgaaaacaccaaggttcagaacataaagccacactcactcatgaggtaagagccaagtgattctcatggaaaatggttatgtggtgactatttaaagttcagaacaaatggttacatgtcagcagcaccactaataaaggcccccagcagcaagccttggcaccttggcaaaatttcagaatccggagttcagagggctccaggaaatgccaagtcttgtccctgctctccaagaaagagaatcggcatgtgctgaggccagccccctcaaatgatctatttctaaatgtctcactgaaaggcgattccctggtgcccagggtggtcagcctttctgacacccaaggtcacgtcgttaagctggattccacagccctaagcaaggcgtgcttctgccccctccacttgtcctcagaaagtcccacgcctgtgttgttctccttgcctgcagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggtagggtaacccctgggttagaaaggtaaaacctgcccgtgcagcatgggatggcagaacctggtgtcctcccagcaactcagtcttagggaacaagcctcagagacctccctggcttggggctggaagggaggttggaatcttgaatggggcagagggctagaggagacccatagcccaggatctgggattcctagtgtctgctcctagtcttggctctaacttgccatgcaaagactctctctgccgtcatggaaaatgccatgctgtgtgtattacctttactgctatgaagtactgtccccatttcaatccagttatactctgtgtgctcctacgatgtggcagacactgcaggacactctaccttcctccgtttgtgtaggtgagcatgaagggtggagccccaccactcaggagtgtacagactaggggacaaattggcacagacaaatgatgacgatatttgatgtgttccaccctgagccatgtaagagagacctaaccaatgtgctctgataaagaattctagaaggccccgtgtgctaggctctgaaggagcaatcagggctgggggcaggcccagagcccggtggtccatgcaatccccagactcaagatgatttccccatatctgctgttggggggccacaagtgggaaagaagggtcttctgagatgccacagccctcaagagaggggacccttggggagaaaatcattgtttcccatgcgccaggacagcaaggggatctgggaaggtcagggctacaagatggtatgtagttacttaggcccctgggtcaaagctcatctaagggcctgcactgtggttccttgaggaaaccttctgggtgactagtctctcaaccagattggcagtgctatactgatctaaagactgtataacctgcatagccccaaataggtgttattatattagcccctttccagaaaatgtttgacaaccctcatgctaaagcaaaaagcaaaatactgattagggcactattttttttttttttttttttttttagacagagtctcgctctgttgccaggctggagtgcagtggcgcgatctcggctcactgcaacctctgcctcctgggttcaagcgattctcgtgcctcagcctcctgagtagctgggattacagccacacgccaccacgcccagctaatttttgtatttttagtagagacagggtttcaccatgttggccaggatggtcttgatctcctgaccttgtgatctaccccacctcagcctcccaaagtcctgggattacaggcatgagtcactgcacccggccaagggtactattttttaatgctcaccatcagttactatgcttaggactctacctgagtgctgccactctccaaatcaaccagatgagagagacaccatgactatccctcttacagatgaggaaacagggtcatagcagttcaggaatccacacagggtcccacagccaggaaatggcagaccttgaggccgggttggtctgactcgaaatcctgtgctatctcattacctgccatgaaagccacctgacaaatatgaggtgtgaccagcaggcacctttcctaatagacacccagactgcaggagggaagagtacgtttcacccgctgtctgctcctctttttgctatgatttcctccttgctccattttttcctctttcccaggctcagaaaattgttagaaaaatcacagccactctcagatggaactcagctgttccaaagcccactctctaattagtgtgtgatttgggacttctgtggaatcacagatggggatcctgggagaaggcatcaatacttaggattattaaactagtaaactagctttctctcgagatgcagagactcccctgctgggctctgagacttggtacagccccaaagggcagaaatccagccaatctaggcagaagtctcaggcacctagcagcttctctcactgccctctagaagagcagccatcattcactcattcattcattctgcaaataccttgcccagtttctaccatgtgccaggcgctgtgccaagagctggggacatagcaacagtaattaagatgaagccctgaccttgcagctcatccatcctaataattatcatactttctgtagctgtttctgttctgcaaatatgtactcacaaccactttgatcactgacctgtttactacaaatgtgaacaacctcagagggtggcatggagtcagaagtaggaggtgactttctgggtgtatagggcaggagaaagctggaagtccaggccaggcagcccctcgccccagctagagggtgtgggctgatttgaacaaggtgagtggagccctcagtcattgcagcccagatgtttttcttctctaggccagatgggttaacagacttgcccacggtgcccagttctagctggaagatactcagccaaaagtgccatgtgcatcaagagtgactcacagggcaatccactccaagagcagtctttgattattattattatattttaagttctaggatacatgtgcagaacgtgtaggtttgttacataggtacacatgtgccatgttggtttgctgcgctcatcaactagtcatctacattaggtatttctcctaatgctatccctcccccaggcccccacccctgacatgccctggtgtgtgatgttcccctccctgtgtccaagtgatctcattgttcaattcccacctaagagtgagaacatgtggtgtttggttttcagttcctgtattagtttgctgagaatgatagtttccagcttcatccatatccctgcaaaggacatgatctcattccttttttatggctgcatagtattccgtgctgtatatgggccacatattctttattcagtctatcattgatggacatttgggttggttccaagtctgctattgtgaatagtgctgcaataaacatatgtgtgtatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagcattcctttttctccacatcctctccagcttctgttgtttcctgactttaatgatcgccattctaactggcgtgagatggtatctcattgtggttttgatttgcatttctctgataagcagtgatgatgagcattttttcatatgtctgttggctgcataaatgtcttcttttgagaagtgtctgttcatatcctttgcccactttttgatggggctgtttgttttttttcttgtaaatttgtttaatttctttgtagattctggatattagcctccaagggtagtcttgcatggttcactaagacctgagagaaagagaggggcagggaaaaccagggaaaggaagaagaaagaaaggattactttagtctgcaggtactttcagcagcagtgcccagggagcaggtgttgaaattgtctggctatggtgcagccggctaggctagttagacctcaccctatgcaaaagtgaaaagccctgcagaggctgacaggtgctgactcctctcacctggtctgtaggtagcagaggactcaagtctggtaaccctgtggctatagcccgggctacctgtggccctctaataatcagtgatgagccaggaggctggtgcccatcccaactctgcagtcacctctctgggtgcctggtacaagtccctgggcctcagttccttcactgtgaaatgagagggttagggagggctgtcaactgagaaagctggagagccatggattcaggacttaagttttgctgtcagactggacctcctttccaaggcttggttttgccacttcctgcctacatgacctctggcaatgatgttccctttctgaatctgaggttcttgtgcttaaaatgggaacaaaatcagtagccctcttgaggttgtcatcaagattataaatggaatgtgttacccttttttcacaaatgtttattgtgtgcccactgtgtcccaggtgctggagttgcatagtgtgaatggaggccacagtggagcttactttctagtgggatggacaatgtaattgcacttcacacacagtgtttaataaatgttagctgctaccattcatttcattgccaagatcctttgaggctcccaaatcatttcttcatatgaccagtccctcaagacttgtggaatcattggggtcatgcagaaatggaggcttagaaaagttaagtaacttacccaaggtcatagaggtagtaaatggtaggattggaactcagacacagttaatctggtttagagtctatgctctcagcattactcttattctgggttattaataattgttgttttgactgttgtcattagaattgtaatttatgacctttactaagaacttgctatatgcattttctcacttcatcctctgatatctatatttcttcatagcatttaatgctgcccgatgttatatatttaatcacttcctttctgtcttccccatgtgactgcaagcttctttgagactgattctgtttagttcatggctttaattatggcatctggaatatagtaggtgcattgcatatgcttgctgaatgaatgaatccactagaggccacagtgagcaaagaaaaaccgatttcaacccttctgagtgcctggtccaggatggatgaacagacatcctgggtgtgacagaaggggaggaagcttagggagtcacggtggctgttagccagggctccagcctggtaccagacctcattgaattaccctcattgcacagctgggaaagagggacaaagctggagggaagggccacaggactgaaagctgtgacatctggagggacaagcttccatggggccttcccccactcccactccccactccatcttggcacagcaggccacacatctgcctcttccttgggatttcgagggaagggcatcttcttcctgctcaacagaggagacttctgaccttcagctgatccctgcccacacactcccttctctttcctgccaggtctccccagagcttggattgcaaccaaacacccacctcctaggaggggtctttcggtcattcttgtcccttgacggatttgttgaaattccaaataaactcctgtacgaatttcaggagagttactctaaagctgcgtgcagggatagatgtgtttgtttggatgcctcacaggggcatcagcacctccttcaaggtgtggttattgccagttgcctctgggcatgatctaccatcatacaccccagcacttcattgacattacttgtcattctgttgatgaagcaacctcctggagctggaaagaactatcttttcaaacatagtaatgaattacaattctcccgctgccccaggaacctgatgggtccatgcagggattctgaaactgttctctgaggccctagaggacagaggtgtcccaggagcttgggggtggcagaaggtgaagggtaatggggaattctggcctcctccccgctgctgcattctgagtagcctttctttgttctgttttgtatgttggatttgagtatatggtatatgaaaaatcacattttgaggcaaacaaagaaactgctattgaagcgcatgccgcatggaattcctctgtgccttgctctcttctgcaagggtggacaccccagcattgacgggtaaatggtttcaaggatgcgtgttggatgcaaatccagcatggttccagcttcagcatttgttgatgggttggaaggcgtccccaggtgagactcccctcctgcatctccttttctgtttcaggagccatctgcaggagctggagaggtcctactatccatcagctacctcccggctgccaaccgcctcctggtggtgctgattaaagccaagaacctccactctaaccagtccaaggagctcctggggaagggtgagtgagatgtgagaggatggccaaggcccctccagctaccgggagtgtgtgctgagggaggtggtgcctgggaggaaatggtcacaggtaagcagggaggtggaatatgagcacatctacggagccatgctcagcggtgttcttcaccctaagttcacaaattgattttcgaggacacactcacttctatgagttcccatccatttactcttggatcaatcccatccattaggaccccagtgtgagctacctggggttccctaccttggagatccactatgagaaccatcagccctaaccacagagcacaagaagccaagggtcagactatagccgtggagtgaagggcctgggctgtcgggaaaacttggcccagcccttgtcacccacacctggctggacccacctttcaggcagatgtcaggaaggccaggttattcccctcctgtctgaactcaccaccactgcactcctgccacccaccccagtctcttctctcttctcagcctttgccaactgccaccctcacaccagctgagtgtgggtgatggcagaaggtgtgtgggtacatgggctgaggcctgaggcttcaggcgtctgtgccccatatacccaaataagcttttctgcaacaccctggaagcctcagtttttccttctggataccccagcccaggtccagcatctcggagaccaaaacaagctctcctatatgagcaggaaagcatcctcagctagccagataatacctggactggaagccacatgcgcctagcaagatataaataagtctctatttatagcagggtacaaataaagaattgccactgcattctgaatttcgagcaaaagacttggggctaatggaatcagaagagttggtcttgctggcaggttcctgagtcaaaggtcaaagttcaatgcttttatctcattccctttagacaattctttgcttcttgctctcttttatagctcctgtcaggacaattacagtacaacacttcgtctctcaactctctctgtagaaataacaaactaacctcccagaggtgataattacagcaataaatacaaagtaacaattattctcacattagctttggaaacattgactaagtaatccagtccagccttgtgatgtgacatgaaagctcgcctggtgacctgtttgtggatttccttggggccagctctcttggtgcagtgccctgggtttgggggagcgtgcaggaacaggcagtctgccttcatccctcttccacatgaagttgggggtcttcaaataaaactttaaaaagtacggatgagaagaactcaaccaaccagcaggggatctcctattttgataacagacaaacatgcttacaccaagaatcaaggggatgaagagttgggagctggcttcatttttctggtctgagtttaaaatccagctgcaggacccctgagctgttgtcatggacctggtttgatgtgaggatatgaagtcatgtagcaaaggtggttccctcttggtactctaacatgccccaatcacaggccacccagtggccagccttctatatcatggtattggccgtttcctacactttagtgtcagttctatggaggcaagaacttctgctgcatccccacttctagaccagtgcctgccatagggtaggcacttaatatttgttgaatgaatgcatggcctagtgggggagtggagaataatccccaatgcaaggaaatgaaagcatcctggatcgactcctagagttatagattgtccgggtgggatgctttcctgctggtatagcagagccttctatggtcacatagacttgggacctgtgctggggtatccagaaggaaaaactgaggcctctaagatgtttgggtatatggggcacagatgtccgaactcttgagcatctttccagcaccaggagggagctttgtcctgggccctgccagatcccagaaactcactcttgtcccttctctctgtctctttttcccctctgcccctccccagatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagataattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtgtaagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctctctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccagaaagtgccagaagcatcgtggcatttccagaaccatggattctgcctttggacccctctctattaatattaaaactctgggccttcagatgtcaccctaatccacttccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaatctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttgggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatggcaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgattccacctcttgcaccaaatcaatatctatttgttgagcacttattgattaagaccttgcatatgtctgtccattttgatttgagatacaactttttgtgtgggttgaatgacaaatcactccaaacaaagctgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacaggg

SEQ ID NO: 18 - DNA, 115285 bp, Homo sapiens
gcgcccgcccgggaccctgcagacgtgggccagccatggagcacatccgtacgcccaaggttggtgacaccagcgcgggcggaggagggacgggaggagatgggggaggaggaggagggatgctgagcgcgcgggaggccgactgctttgaggggcaccggcggagcctggaccgcgggcgagggaggagcaggcattgcctgagcatcccggggtgcctgcgagcccggtcgttctcttgctgcctcccaggcctagccttagctgctgctgggtctgacctcttggttttgggggagcgcagtggacacaagggtgaacgggagggaacctcagttgtctgctagtaactgggtgtagatcaacccttctttctcctggcacgaggctttctcttttagctgttggccgctcagagtagttgaaagggaaataagcctttcggtgacaggtgcaaggaaaacgagctaaatgcagagggactcctgcgcttggaagcttgttaaatctagggtgtcaggcccacccggctcggccttcccagtcagcatcctcatcctgagcgtagcagctgcaaggggccttacacagaacggataatcaatattcattgtaggttgaatgatggtgtgttcttgccttttccagtccgttttgttcgttagagaaaaggatgcagcttacggattcgtcacgcactgttgtgttttaacaacaccagcttttgctaattaacaaaagcaaatggtccctgatcactccagtaaattaacattggaaacgttgatcgctgtaccaaatcttcctcctcagttgtactgataatctaatttagaatgaaaatgatgatcgacgttactgcatgataaaaaccctaaacgagtgaaagaatatgcttaaaaaccctattggctgtctgttgttactaccaccacagctccttgcgtttttgcaggatgaacttccattcaaaatgtaggcccctgacaggtcaaagctaggtcagagtggccatagctcaggtggttccagggatcccacacatttaagaggggtgggggcaattgctttatggccagcaagaattgattcctaaattttggaatagttcctgagtacctttttgtaaaagcagattaaaatgatctcatgtcattggaagaagaaatcttttagtttgctggagaatgtcagttccgacagtaaatttaaattgtattgattttgcactagggaattaagttgtcgcttcacaatcatgaaattgtaaacttagaagacaatgctacaaaccacagaataggtggctcaaagctttcagagtttaagtggtactaaataatttattccagaagggtgaatttaactcatggactctgcccttgccaagggcattcttcctccttccatgatgaagggagccgtttgtaaaagtgatagctgttgtggatattgatagcaagaatgatacagtgacatggcagtggatgccactttgttagagaatatgaatttgggggagtcaaggccttttctgttctatatacaaagccacctggtacaaagtcacgtgtgaacctgagttgcaagcagtgttcttactcttaaaattggtgtttatggataccctctaagcagtgcagtacttgaagtcagaaatccttatttatctggaaatggaaacaaattgggggaaaatggaaaattgtctgaagtgttactgaattgggtgagtcattaacatttgggataaagctggtgaaaaaaataagaaattacagaggttggatggatcggattcatttattcatttattttattctacaagcatttagaacctttcatgtgccaggctctgtgttaagtgctggaagcgtccaggaactcacaatctctaaggggaggcagttgtaaatatgtcagtgtatgatagagacatgtgcaaggtgcagtgggtagagagggagactgaagagaggatcagctctgccctcaaggtcaagggaagccttcttagaagagccgtcttaacatggaaggacttaaggaggactaggagcattttcaacagtggtcatgtacttgtataaatatatattgtaataaataattacaaccctaaagaaactgaaaacaataacaatggtcaaagataaatgattccttgaggttaaataacatcctccttttgttttacatttttaagggcaaaattaattttcacagtctaaatgaaaaagagaacaacattacttacagagcttgcagagttaaatatataattgttactggtcatattcatctttattatttgcttccattatacttggtgaaactataggtaaatttccttcgatttcatggtttcatgtcttgggtttgcaaggagtgtatacaaagtttgtttttctggcccactgtgggtttatagcaatatttactgtgtgggtagtagagttttaagaggaaaagaattgtatgcatgtataatgtacagttgcttttctgttacaatggaagtcattcactcgctgtagactgtgtaatatccatgacagcctctgtgttctgctttagtctctggagtgcagtttaaggagacagatgcacgtgcataatctggaatgctttgcacatatttctttctaggggtgcatgtatgtttaactgaagcctttaacagagcatatgctaagcagagtgcttcccttccagaatggttcctctagaggggaaaaaaaagttccaaggacaggctggtttgcagttgggttaaaggggggacaccaagtattacctgtactcatcccagtgaacttctaggtttctacttcactgtctgggtttccttaccactctgaaaacttgctggaagcttaggcataatttgggttcaagtgctgcttaattaaatgaaaagacttcagggctcctggaagtagcttgaagtgtttgtaggatttagtttggtactagattgaggcaaatgtgtccaggatcctggtaagtgatttctactttatatgctttggtctttctggaaggcatttttcccacatgtgtaaatttgagttatgaaatagaatacgtgataacctccaaaacagaccttgcaaatgtcttctcttccttggtacacctaccccctagtctgaccctgactggtctcctgatttatttttttttgctcttttctaatccctttctcacagaggggcctggatgatgcttttatgtctcaaattgatcatgctacttccctgctaagtttcctaggtggcttccctttgtacccaggatataaagtgagaatcctcagaactgctcgtaaggccctttgtagactgagcccttcctacttctccagcctcgttttgtgacaatcatcttcttatccacaaccctctgatcacaacttgtcttcacagagttctccagtgggaccagttcttttctgcctcgggacttttgcactgctgttccatctgggggacgttagttctcactcttcacctggctaaatacctcatctttctagtttcaaattgtgatttctcaggctgttgtccaactcccccatctaaatcagatctgcctgttgtattttatcataacaccttgtgttttccccttaggttcctcattacaattgttaaatttatttgagttatgttcatttaatgtcaagctcccctgcttgatggaagtcctgtaatggtagggattatattttgttcaccctttgtatctatagcacctaacacagtgcttgggaccaactaagcatgcagtaaataaattcagaattgaattagtgaagaatgcataattaattcattactttttgtttgtttgtttgtttttgaggccgagtcttgctctgtggcccaggctggagtgcactggtgtgatcttggctcactgaaacttgactccatctcctgggttcaggtgattctcctgcctcagcctcccgagtagctggggctacaagcacgtgccgctacacctaggtaatttttagatttttagtagagacaggggtttcactatgttggccagactggtcttgaactcctgacctcaggtgatccacttgccttggcctcccaaagtgctgggattgcaggtttgagccactgtgcccagcctcattactttatttttaagaatttgctttattaatccaggcctcttgtgcattgtacagttgtatacaatactacttgacagtgttgtggatcttatagtattagtgtgaaatatttgtggatgtcagtgtatctgacataatatgtgagatatatatgaaacatattttgcaattatatatatttaatgagataaaattcaaataatgtaaaattcaccatttttattaaaatgcacaattcagtggttttagtatatttacatattgtgcagacatcaccaccatctggttctagaacacttttgtcacccccaaaagaaatccattagtagttagcccattagtagttaaacttgatgatgcccatcaagttacccattagtagttaggcttgatgataatatcttatacttctctacgttgaatattatctcattgaatttagacttttgctcatctcttactcttttttggatgctgatacacatctgctgttcctgtcagtttggtaccatccactatttaatcagcttgctttctgttacctcattcattgtcttatccaagagcagaagtgacttcttaagccacttgcccccatctctcaggatcttgatcctaatagcagattcagtagttctctcagtttgatgtcatctagcagttgataagtttgtccttcatcacgtcgccaaagagctcatcaaagaaagaaaggaagtcttctgaaataatgacggtgaatccatgatgttctttttttttttttttttttttttgagacggagtctcgctctgtcgcccaggccggactgtggactgcagtggcgcaatctcggctcactgcaagctccgcctcccgggttcacgccattctcctgcctcagcctcccaagtaggtgggactacaggcgcccgccactacgcccggctaatttttgtatttttagtagagacggggtttcaccgttttagccgggatggtctcgatctcctgacctcgtggtccgcccgcctcggcctcccaaagtgctgggattacaggcgtgagccaccgcgcccggcctctccatgatgttcttgctgattgatggtttccactttttaggttcatacaaaggtccattaaataactcattttagaaccctgccagaattagtgttgaactcaacaacttataattatacaattctgttttcaccgtgggcaaatagtgatctcattttcaagttctgtctgtgatagacggacatcagcagatccatgaggtttgccttctcttgatcattcactgtcagtatactgtcagctccaagggttatctcttcttttatcttcctttagcaaataataattttctggttataaaagtaatatggactacatgtagaaattagccacttttaatatttgggtacattttcttctggtgttttttttctttgcgtgcactaaacattgtttgcttagaaatttaggatcacccagttcaattttgtagtttgcttctttaaacgtaccatatttcagtgttcaaaacatacttttagaaggttatgtggggcttttttttttaatcctatggaaatgtcattatatttaccacttccccattttagggctattataataatgtcctgatgaacatctcattattatctgcatgtgatttcttccctagaatagaaccctagatggaattactgtgtcaaagaagatgaatagttttatagttggtatatattaccaaatgactttccgaaaacgttatgtcatttaacactttcattaatagaatatagactatgtttcttactataccattccattgctttcttatttaaggttattttttgctaatttaaaggggagaatagcacttcattcttttagtgtatttttttttaccagcgaggttgaagtttttccaaaaatatgtttactgaccattttgttactttttgaattatctatttatattttccccattttaataatgggtgatttagtgtgtgtgtatagtgtgtgtatttcaatagctttattgaagtataatttacctagcataaaatttacctttctaaagtatgcaattttgtgattttttggtatattcacagagttgtaccaccatcatcattatctaatttcagaacattttcattactccaaagagaaacactatacccattggcattcagtctccatttctccctcaccccacccaaggtaaccactaaatatacattctgtctctatatatgtttgtttttctggacattttaaatttaatcatacaatatgtggccttttgtgacctcttcttttcacttaatgtttttaaggtttgtctaagttgtagcatgtatcagtacttcatttcgttttatctgttctgtggctaatcctgcattttgtttatacatttatcagttgagggagattttttggcaattatgaataatgctgctataaacttcggtgataagtttttgtgtggacgtatgtttgtatttctcttggatagaatttcatttctctgagaacagaatttggtgaatcgtatagcaactttgtggttatcattttaaggcactgccaaattgttttccaaagtggctgcactatttcagaaccccgacaataatgtgtaagggttccagtttttccatatcatcactgacacttgtcattgttttttattttagccattcaggtgggtgtgaagtggtatctcatcctggttttgatttgtgtttttctaatgactaatgatattgagcatgttttcgtgtgcttatcaaccattttcctgtcttttttggagaaatgcttattcaattcctttgtttctttcttgagttatttttattaaattattgggttgcaaaattatgtaatctggatacaaatccttagtcagttatatgacttgtaaatgtttcctcccgttctgtaggttttcttttcactgttttgatgtctcttgaagcacaagaagttttgaattttgatgaagtccaacttattttttcttttgtcacttgtgctttttgtgtcatatctatgtatattttctagaaagcctttttctgattataaaagtcatacattacagaaaatttagttcaaaggagcagaaagaaaatagtaattttgcataatttcagatatttgcataaatccagaaatatttgcataaatccagaaaaaatgctgtgtatatattaacatttttctttacatatataaaacagtgtaatttaaaagaaaatcatgtccattttctctgtggtgtgtgtgtgtgtgtgtgtgtgtgtgtgtgtgtgtgtgtgtgtatagttttggggaatgagaacctgttttttaatatgtcaaaatatttttctcattttattaaaccttctgaaaagtgattttttttttaaccacatagtccacattatgatgatgaccatacattatttagtgtctggaggcaattctccatggccttttgcagttttgcacttttgttctatactatcttttcaaggatgattttatagtgaacagccttgaaagagaggaatagcttcttccttagtagcagagggcatatttatttgctgtccggggtaataaagataatgtcatcctcacaaaggattacttgcatcctgtttatgtgatgggcatttcttaaactctgagtctctaaagttcctcatctaggactcagagccctgctctgtgcagcatccatatggactgctccatattgccccttagacttgggagggggagcgtggagagtcaatatgaagataaagcttctccctcctggtgtacaggaatacgaatgtcctttgtctctgacccagaagtcttgtgtcttctgccagcatatgaaacactgggaggctacttgttaggttgtaagcaggttcaaatttcaaacacttcctagttcttgacagtgaatcccctagtatttgatatttaatttatctctatattgtcactataataaataactgataggctgggcgcagtggctcacgcctgtaatcccaacactttgggaggccaaggcggacggatcgtttgaggtcagaagttcagggccagcctggccaacatggtgaaatcctgtctctactaatttacaaacctgtctctactaatataaaatacaaaaattagccagtcatagcggccagtgcttgtaatcctagctactctggaggctgaggcaggagaatcacttaaacctcggaggcagaggttgcagtgagctgagatcgcgccgctgcactccagcttgggctacagagcaagactccgtctcaacaaaacaaaacaaaaacaaaacaacaacaaaacaaaaccaaccaccaacaaaaaaacctgataaacatcaatgtatttaaattgttgggtaagtctctattacctgagattaagtttctcaggtatcttttctggtttcatttctatatatattttaaagatttttgatgctgtttgtatgttttcctctaggattgtgtctgctagtatggcagaggaataccctttaaaaaattcttgagaattgtagatgaagtatggtttctcatcaatttatgtttgtttactgttgagattgaatttattttttgcaattgtttgtaacaagagcaatacaataatagtactgatagtactgataagatccataatatctataagattcatagtacctggatcttattaagaaaataatttgtatatctaataggtacctcaatttcactatgtcccaaactgaactaattccctctcgcttcacacccaattttctcctcttgtactctttccaatctcggcgatccaccgttccagtgctggagccaataactttggagttatccttcaatcctctttttatctcctcccatatctattccaatagtaaatcctcaccttatccaggttatcccacctccgttcctaccaccctattctgaaatactgtcaactcttgcctggtcccctttccatttttgccactcccccaccagtttatttttgccagagatactgttaaatataatttggagcttggacttctttcgtgggtctcctcacacagaaagcatctaaactggaaaggaaacagtcaaattatccttgtttgcagatgatatgatcttatatttggaaaaacctaaagactccaccaaaaaaagattggaactgacaaagaattctgtcaagttgcaagatacgaaatcaaaatacaaaaagcagtagcgttcatgtatgccaacagtgaacaatgtgaaaaagaaatcaagagaccaatcctatttataatagctacaaataatataaaatacctaggaaacaatttaacctaagaagtaaaagatctataaaaggcaaactataaaacgctgatgaaagaaattgaagaggacacacaaaaactgaaaagatattccatgttcatggattggaagaataaatattgttaaaatgtccatacaacccaaagcaatctacaaatttacaatccttatcaaaatgccaatgccattcttgacagaaatagaaaaaatcataaaagttacatagagtaacaaaagacccagaatagccaaatgtattctgtgcaaaaagaacaaaactggaggaatcacatacctgacttcaaattatactacagagctaccgtaaccaaaacagtatggtattggcataaaaacagagacatagaccgctggaacagaaaaagaaacccagaaacaaatccacacacctacagtggacttgttttcgaaaatagtgccaatgacatatattgggaaaaagacagtctcttcaataaatggtgcttagaaaactggatatccatatgcagaagaatgaaactagacccatatatcttgccctaccaagttaaaaagcttcttcacagcaaaggaaacaaccaacaaagcaaagagacaacccacagaatgggagaaaatatttgtaaactatccatctgacaagggagtaataaccagaatatataaggggctcaaacaactctataggaaaaaaaatctaataatctgatttaaaaatagacaaaatttctaaatagacatttctcaaaggaagacatacaaatggcaggcaggtatatgaaaaggtgctcaacatcaggaaccatcagagaagtgaaaatcaaaagtacagtgagatactgtatcaccccagttaaaatggcttttatccagaagacaggcaataacaaatgctggcaaggataagaagaaaagggaactctcatgcactgttggtgggaatgtaaattagtacaatcactatggagaactgtttggaggttcctcaaaaaactaaaaacagagctaaaatacaatccagcaagcccactactggttatatatgagtatgtccaagagatacctgtgctcccatgcttatggcagcattattcacagaagtcgagatttggaagcaaactaagtggccatcaacagacgaatgtataaagaaaacgtagtacatatatacaatggagtactattcaggcataaaaaaggaggagatcccgtcatttgcagcaacatggatgggactgaaggtcattgtgctaagtgaaagaagccagctacagaaagacaaacttcacatattctcgcttatttgtgggagctaaaaattaaaacaattgaacacatggagacagagggtagaaggatggttatcagaggctggggaaggtagtggggtctggggcaggtgagggcggatagtggcaattgttaacggctacagaaagtagttagaaagaatgagtaagacctagtatttgatagcacaacagggtgaataataatttaataaataataataatttagcattttaaagtaactaaaagagtataactggattgtttgtaacacaaagaataaacgtttcaggagctagataccccatttaccatgatgtgattattacacaacgcatgcctgtatcaaagtatctcacatactccataaatatatagacctactatgtgctcagaaaagttaaaaaaatttttaaaaataattttccagaattttattgatagactgaatttattatgtcttgtttatatcagactactttcaaaagaatttgagacctttgtaaagtatacatgatttaaaaaataaccctataaaatatgttttgtattgtcattccatagttccttaagataaggtacttatccataagatccataatatgcataagattcatagtacctggatcttattaaaataatttgtatatctaataggtacctcaatttcactatgtcccaaactgagctgattccctctcgtctcacacccaattttctcctcttgtgctctttccaatcttggcatttcacccttccagtgctggagccaataactttggagttacccttcactcctctttttctctccttccatatctatgccaatagtaaatcctcagcactctacttttaaaatatatccaggttatcgcacctccattcctaccaccctgttctgaaatactatcaactctttcctggtccccttttcatttttgccgctcccccaccagtttatttttgccagagatactgttaaatataatttggagcttggacttctttcgtgggtctcctcacacccagagggaaattctataccttatctgccccttctccctctcaaatctcatttcccacaactaccccactccctgttcttggacctcactgcttgaccactactccctggatacccaggcacactcctttttcaacacctttgcacgagatgtttcctgtgcctggaacttgctttccttagatgtgcagatggtttgctcccacacttttttagatctttgctcaaatgttattttatcaagaaagccaatttatcatcacatataaaataacaatcctaactcacctcaaccaacatactttacctctttatatttttctccatagcattttttctgtaacatacatacacacctacacacatacacataccacacacatgcatacattccgtatcccccgaattgcaaaggtacctggcagctagctgcatttatatacaacactgaatgaatgaatatggattattaggttctataacagaccgtgtgttctgtacacccaagcctccatgcaagaccaccagacttcaacttttgctagacctgttaaaagtgaggatttcatgaaatgtgggcgatttttgaggaatgtttaatcacaacttctgtgattacttggcttagacaatctattcttacttggaaaacttaaaaaagaaatactgccacatctacacttttaagtggattgcttcattccagcaaacttatcttatcagccttgtcttttgagtaagagcgtatttgattacagtgactacctcctcaacagctgttaaatattgtgcaataaaagtctgacaattagataagaatccatctttaaaccggtctaaatcaaaacagtactgaggtttgttcttttgataaaatcaaattgcaacgacaagaaaaaccaagggtaacgcttgataatgtagaggtagcccattactctagaggcagggaagcacacaggactccagagggcctggagatagcattgtaaggccgctgggatcctaaactgcattttctttcctgttctcaacatcaaaacgcaaaatggtagagttgttaagaacacacactctggggccacaatgcctggttttgaatcctcactctgcctcttacagctcactaacttatttaactttagtttcctcatctgtgaaatggggataacaacagtactcacctcttagggtgattttgaggtctaagcgtcttaataaatgtgaatctagaatggtgcctagcacagtagctatagtgttatttcagaattttcttttatcagtactatcggtactattgttgtattgctcttgttataaataattgcaaaaaataaattcaatctcaacagtaaacaaataaacataaattgatgagaaaccatacttcatctataattctcaagaattttttaaagggtattcctctgccataatagcagatacaatcctagagaaaagcatacaaacagcatcaaaaatctttaaaatgtatatagaaatggaaccagaaaagatacctgagaaatttaatctcaggtgatagagatttacacaacaatttagatacatggatgtttatcagttttttggtttttttttttttgagacagagtcttgctccattgtatatatgtactatgttttctttatacatttgtctgttgatggccacttagtttgcttccaaatctcgactactgtgaataatgctgccataagcatgggagtgcggatatctcttggccatactgatttcctttcaggtaatgtgattcctccagttttgttctttttgcacagaatacatttggctattctaggtcttttgttgttctatataactttcaggattttttctatttctgtcaagagtggcattggcattttgatagggattgtattgaatttgtagattactttgggttgtatgggcattttaacaatatttattcttccaatccttgaacagggaatatctttccatttttgtgtgtcctctttaatttctttcctcagcgttttatagtttgccttttatagatcttttacttaagttaaattgtttcctaggtattttatattatttgtagctattataaataggattgctttcttgatttctttttcacattgttcactgttggcatacatgaacgctactgtttttcgtattttgatttcgtatcttgcaacttgacagaattctttgtcattttgaatcgttttttggtggagtctttaggtttttccaaatataagatcatatcatctgcaaacaaggataatttgactttttcctttccagtttggatgctctttattttttttttctcttgtctgattgatctagcttggacttctagtactatgttgaataattgtagtgacaatgagcatgcttcctgtgttccagatcgtagacaaaaggctttcagtttttccccattcagtatgatactagctgtgagtctgttgtatatgtcttttattatgttgaggtatgttccttctatcctcaaccctcggaagttaccagaggcttgcaaatactatcatccattattttaaattgatgatgccctagctctgattgcttgagcaaacagacgtgcaaaaggaaaactaataaaaactctacactttcacttcatatccccttctttttaacttttttgttgcatctcttgatgtcttattgtactatgccttgaaaagttgtagttaccattttttattggttcatttaatcttttattggttatttaatctttctacttaagagtagttcacacaccatagttctttaggttgggacgttctttgtggttatcgctttgaatacactttatattcccatttctttctctacctcctctttaaggccagtaactcttagatttgcccgtttgaggctttctggatcttgtaggcatgcctcattgttttttactcctttgtgttttgtcccctctgactgtgtgttttcaaatagcttgtcttcaagctcactaatttttttcttctacttggtcaattctgctattaagagattctgatgcattcttcaatatagcaattgcatttttcaactccagaatttctgcttgatgctttttaattatttgaatctatttgttaaattcatctggtagaattttgagttccttccctgtgttaacttgaatttctttgagtttcctcaacactgcaattttgaattgtctgtctgaagggtcacatacctctgtttctccaggattgtttcctggtgccttggttcatttggtaaagtcatgttttcctggatggtcttgatgcttgtggatgtttgttggtacctgggcattgaagagttaggtatttattgtagtctttgcagtgtgggcttgtttgttgtcatatttattggaaccttccaggtattcaagagccctcgggctttaagcgaacgtcggtggtggcctgcagaaaccccatgttttgcagactcacggaggtactgccttgatggttttatataagatcctgaagaattatttggattatcagagagatagtctttttctcttcctttattttctcccaaacaaatgtattctctctttgctgaactatctggagctgggagtggggtgacacaagtacccctgtggccaccaccactgggactacactgggtcagacttgaagccagcacagcactgggtcttgcccaggatccactgtaaccactacctggctacttccaaagttcacttaaggccctagggctccaccattagcaggtggagaagccagttaggcatgtgtccttcccttcagggtggcgagttcccccaggccctgggcaggtccagagatgttgtctgggagccaaggattggagtcaacatccttaaaaacgtacctcatgttatattctactgcaggaaagctggccctcaaaacacaagacaaagtctgtcctgctcttccctctcctttctgcaggcagaggagcctcttccagtagccaccactaccactggtccatggggtttctgcaggccaccaccgacgttcgcttaaagcccaagggctcttcagtcagcttgtggtgaattctgcgaggcttggagcccacccttcagggcattgagctcccctctagcctagggcaggtccagaaatgatgtcaagagccttggcctggaatcagggaccccaagggaccacgtgatactctatcccgctatggctgagctagtacctgaggtgcaagacaaagtgcccttaacttttccctctgtttttttcaagcacaaggagtctctctccatagcctccacagctgcaaatgtgctgggctcccctgaagccagcacgcctcagtctcacccaaggcccactgtgtactacctgggtatcactgctcattattcagggcccgagctcttttgtcagcagatgatgaatgccgctaggactgggttcttctcttccattcggcaggtttccttctgtcccaaggtgtgtctagaaatgtcatctgggagctaaggcctggaatgggggcctcacaactaactctgcctggtatctgatccttttgtagctgagttgttaatgaaggtgcaagacagtcctttttactctttgctctcctctcctcaagcagaaggaaggagtcacttccagaggcactgcctggggttgtgagaggggtggcacaagcattcccttagccaccccagcttgtgtctccctaggccacacgctaccccagtccgctgactctaaagccagcccagcattaggacttgactaggagttgcagtcctgtgtcccggattgcctttcagatttaccgaggacctgggagcactttagcctgcagtagtgaggcttgccagaattcaagttctgaccactgggataggcaatttccctctagctaaggctggtccacatactccctgagcccaacacatctttgctttgctatggtagggcagcactgagttgaatgccaagtcctcaagtagctatgctctccttcccgcaagtgcacagattctttttccacgtaggagaaagaatctgtgaacttagtcactaccaggggatgggggacaggttgcctcggcaattcaagactgtctttgttacccttgtcagtgcctctttcagcaatacaaagttaaaagcaggtactttaatagctcacctgatttttggttcttatgatggtgcttttttgtgtgtagttgttaaaacttggtgttcttgcaggcaggatgatctgtggaggcttctatttggtcatctctctttccatccccatagtttgtctggaatttttttttttttataaaccgtatgttggtatgatcagccatatctcctgatggatattattatattatttaacattgaatattttattctatatcatgtacataaatatacttatttccggtagtttaatctttgttctttgtcaccttcccctatcatatctgttaagattgaggtcatagactctaaatacatttcccagtatgagaagaatgttgtatttaaaagtatactggatggctcctttgtaatgtgaaagattctgctttgctttttctggtttctatgcttaggtgtttacatctgtttaaaaaagcaaacaaatatacttgtatacttggatacttatgtgcaacaccacagccaacccagtttaaacagtgggcaaaggacttgaatagacatttctccaaagaagatatacaaatggccaataagtacatcaaaagatagccaacatcaccagccattagggaaatacaggtcagaaccacaataagataccactttatacccattaggatgactattacttaaaaagaaagaaagaaaacaacaagtgttggcaaaggttgtggagaaattggaacccttgtgcattgttggtgataatgtaaactggtactgctgctgtggaaaaccctttggtagtttctcaaaaagttaaatgtagaattatcatatgactcagcatttccactcctgggtatataccccaaagaattaaaaacagggacacaaacagatactggtatgcccatgttcatagctgcattattcacaatagccaaatggtgggaacaatccaagagtccatcaacaaatgaacagataaacagaatatgatatgtacatgcaatggaatattattcagccttgaaaaggaatgaagttctgatacatgctacaatatgggtgaaccttgaagacattgaagacaagtgaaataagccagacaaaaaaaggacagataatgtatgattccacttacatgaggtatatagaattcttagaaatgaaaagtaaaataaaagttatgaggaactgagggtaggggaaaataagggtttttgcttaatagttagagagtttttgtttcaggggttgagaaagttttggaaattgatagtggtgatggttacacaacagtgaatgtacttaacgccactgaattatacgcttaaaatgctttaaagtatatcttttatgtgtattttgtgacatttaaaaaaaatacatttcctggcacataaccactgctcagtaaatacttactgactgaatgaatttgtcgaatgaactaatacttaatttggcaaatgtatatcaactattagcatgacagtgggtggcattgtgggtctgatgtcagacactcagttaaaattcttactctgccacgtatatatatttttgattttggcataattaaaaaactaacatatttacatattataaaattcatcatttaaaagtatacatttaagtagtttttgatgtattcacaacattatgtaaccatcactactctctatgtaatttctgaacattttcaccaccccaaaaagaaacctggtatttactagcagtcatccctcctttctctctccctacaccctggacaatctctagagatttgcctatccaggacattttatataaatggaatcatacaatttatggtccgttgtgactggcttctttcagttaagcgtaacttaagattttcaaggttcatccgtgttgtagcatatatcagtacttcattactttttattgctgaataatattccattgcatggatataccccacatttgtttatgcattcatcagttgatggatatttgagttgtttctactttttattgggaatagtgctgctatgaacatttatgtataaatttctttgtgtgtgaaaatatgttatcagttctcttgggtatatactcaggagtgaaattgttacatcatatgttaatgcatgcttaatctgttgagaggctaacagttttccaaagaggctgcagcattttatattcctaacagtgatgtatgagggttccagtatctccatatcctcaccaacacttgttgttatctcttgattatagctatcctaatgggtgtgaagcggtatcttgtggtagtttgagttgcatgtacctggtagctaattatgttgagcatctttttatgtgcttattagctattcatatgtcttctttggagaaatatctgttaagattctttgttcattttttattttattatcttcaacgtttgtgttaagtcccaggttacatgtgcaaaatgtgcaggtttgttacattaataaacgtgtcagagtggtttgttgtacagatcatctcgtcatctaggtatgaagtccagcatccattagcttttatttctgatgttctccctcccctcgcaacccctctgacaggccccagtgtgtgttgttccccatgatgtgtccacgtgttctcatcgttcagcttccacttacaagtgaaaacatgcaatgtttggttttctgttcctgcatttgtttgctgaggatgacagcttctagctcctgtttgttttttaaattgggttatctgtctttttaatgttgagctgtaaatgttctttatggatttggggtactaaataattcgatatgtgacttgcaaatattttctttcattctgtaaggtgtctttctcattgttatctttgaaatacaggtttttaatactaatgaagtacaatttatctattttcctttggttgctcatactttaggtgccatatctaagaaattacctaatccaaggtcacagagatttacactgtttaggtctttgatctatgttgagttaatttttgtatatggtgtgagatagaggtccaaatgcattgttttgcatgtggaagtccagttgtcgcagcagcatttattgaaagtaattttcctactccatttaattgtcttcatacccttgttgaaaattgattctttatagatgcttggatttatttctggactctcagttctattcctttaatatctttgtctatccttagccaataccacacaatcttgattattatagctaggtatatgatcttgaaagctttggttttctcacgtatagcttgttagagactaaacagaatacacttaaagcactaaataacatggcacatagtacattttagctgttttcaagttatttttataatcatcctcattgcaaaaggatgtggccacaagtttgtatgctgaaagaacttccatgaaatttgagaataaaaagaattttctaaatccaaacatttcatttgacctactcattcacctccctgctgcacaatgagtttcaatattttttcctctggaggaactctgcaaagaatgcctccctgtaacccaactctagttcacacccagactttggagcatattgttctttaataaaaacattgatctcgtcaaacacatggattttaggaaaggtgtcaagtttcgctcaggaagcctctgcagtggcctatgaggcaaagcctcagtgacatcgccctagattcctgaaagagagtctttttggaatgaaagtatggagaagaaagtgggaaacacactttggctttttagtggaggaaagtaagagggttacatttgtgctgccatgaaagctttaaaaagggatgcaattttaaggcactgtacaccttgaaacatttatatgcttgtgaggaatgataaagacgtgaaactgtaacctcctatgtaagtctacttgagccattatttatttatttattagtaaattttgacatttccctattgaactcacattattaactgattaggtttggttatcacttctgtcttacatctggaggaaaaacagcatttggaatgcttgttttcacagatgtacatatattttctcatccttatttaaagcttatttttattgctttttttcccattctgaacaggacaagctgtgaagtacgcttgaaattaaacctcttgaccagacacccaagattccgtgactttgtccgtgtgatggttcagttttatattctcatactgcactcagagggagtccaagaagctcattttgtaccatatttcttaggccaggaaaagtctaaactatttttcctagtgccctttcccctggtggacagctagttgaagcctctgggagtaaaagtacttcccaggacataaacccaacccttcctcccacaaccatttaaaatggtttaaaaataacccccacttaatgttttgtggcaggctatgacaactttataaaaattgtatgtttacttttctcctctttttcatttattaaaacactgcttatcatagattcccggagaaataaatttattgccaagctgtgaaagtaaattttactccttagggcctgtagcaaagcacacattacttagaacaaggtacagttgatctgtgcaagttgcggtgaactgttcacccagtttgagtagtggtagtttaaggaagggattctgccttttaagctaaacggatacatttaaagaccctattgatgcatatatcctttcacttgtacattctggaagtattccttgagtgctttctctatgccagttttaggccctggagatccagtggtaaataagacagacagtggccctagtttcatggaacttaccgtgtagtaaagaatttgtaaaaattctttagtaaaaaaataatattgcagttctttaaaacaatatatatgtcatcactgtaagctaagattttggaaaatctcccatttttaaaagattttttcccagatcctgccaccctccccctgtaaaccttccagttgcttcctaccctactcagagtgaaagtcaaagtcataacgttgtcccggcaggccctacaaggtttgtccatctactgggcacctcatctcctacttgtttcccctcacagatgctgatccagaagtcctcacgtcctcgtagacccttgaccacatctacctgttcctgcccagggtcttgtcatttgttgttccctctgcctggaatgctctccccagatacccccatggctggctttctcactcattctggttctctactgaaatatctaattatgttattagagaagacttccctgggcacctgatatggtctggctctgtgcccccacccaaatcccatcttggattgtaatctgaattgtaatccccacgtgttgggggagggacctcacgggaggtgactggatcacaggggtggtttccccttactactctggtaagcggtagtgagttctcatgagagctgatgatttcataaggggctcttcccctttcattctgtacttctctctcctgctcccttgtgaagaacgatgtgtttgcttcctcgtctgccatgattgtaagtttcctgaggcctccccagccatgcagaactgtgagtcaattaaacctctttcctttataaattacccagtcttgggtactatctttatagcagtatgagaagggactaatacagtatcctgctggccctcctcactcaactgcttatcctgctttaatttcctctctaggaatcttctggcacacatacgtggtgatacagttccaccatatcttatgccaaattgtaatccccaatgttagcggttgggcctggtgggagatggttgcatgatgggggtggatttcatatgaatggtttagcaccatcgccttggtgctgctcttgtgatagtgagttcttttgagatctggttgtctaaaagagtgtggcacctcctccctcactctttcttgttcctgctcccaccatgtgagaagcttcactccccctttgccttacaccatgattggaagcttcctgaggcctccccagaagcaaaagccgctctgcttcctgtacagcctgcagaaccacgagccgattaaacctcttctctttataaattacccagtgtcagttatttctttatggcagtataagaacaggctaatacatgagggatttctttttttttttttttaacatattccctgtttccatgctttcccaccttcaagcagaaggtacaaactccatgtgagcagtgactttatcttcccaattcatgtgcccccagcactcagaacactctatgtctggtacagagtaaaggtgcacaataaatatttgttgtatgaatggataaaggaaacggtttaatgtgacttggtgtcgaagcttcagtatctttcaatatctttcaacaaacatgtttttttttctcctccagtattctccattttagttatatggccctacttttcacatttgcagatgaagttttgttttattttttccccgtctctgctctgtttcctgtatgtgcaacatcttccacagctgaatctttcctaacttcctgtctgaaaagtcaaattcaataataaagcattctgggttaatcatacttaattctacctataagccatcacataatttatttttaccatagtactgttaattttcattcattgaacaaatacttagcatctgtgcttggcatcaggctacaaagataggcaaaaacattagtgccaatcttcaaggatcctgccaccgagggttgctgtgatgttctgaagtgtgatcattgttgtttcaggaagccagtaagccaaggaccgtgtgtctcttttcctttcttcccacagttctagtgtgagtgtttgcctagcattgttcattgtgctgcagggaatattaggaataaaataacttgggttcccatgagaatatgattgtggtaatggttagagtgtacagtaaagatagcgtgtaatgaagtagtgtaggataagtagaaaccaagtagtgatcagagaggtcacagcaattcagaggacagtgaatgatcccagtggactggggtagttgaggaaaggtgttattaaggaggtggatcttgggtgtcaggctggaggtgagtatgttgcacttggtgagtggcagtgtccttttcttactgttcttggtgacctcagagtgcactgtggcaggcaatcatgcagctttgcttattgggcctcagaagaggcctccacatcattgggtctgcaaggcattctgctttatactcatttcccagagtgggaatgatggacactttagggccggactgtaagaggagaaagagaaaaatatggtgccaattatgcagtctgtccttggggtcttcgaagccgaggagtgaggcatgggaatgtgtaaatgagctggaacctggccttggcctgggtggacagagtgtacccctttgtcctctggcactggtacttgccaggggttggtgggagggagagcatgagacttgggtctctctgtgcctgggctttctcctccctttggttagtaagttctatttggcacaacttgcccttggaaaaatatttccccatagttcccaaagagctatataagtagatggtttcgtcctttgctgttagtgcctttgtcaaaaataggtcaaattcagaatcattttagaattttagaaatatcgttaaaggaaaatcataatcaaatgagcctctgacttcctgtattgcttcaaagcaaggtcttgttctccctatactagtatatgtttttaaaatgactttattgttttgaacccaactatctttagtaggtcattccatacatttactctttgggatacaaagcatcatgtattcactgagttacaaagaaccagcatctgtcctgaatttatttttcttttaacctcttttttcttcttttcctcttctttatgcttgttgaaaatggtatttttggttggggttattttaaggtggtgttgaaataaatcctgggactttgctcttgttcaacagtgcatgttcttttaagcctacatatccagggtcatcctaccaaaataaattatatgggccctttgcaaaattctcaagtgcctgaatttttatttatgagcgttggctgctggcataatgtttgtaatttctcctgagcaaaaatgggcacttttttcttgttctgccttttctaagaatttctatcactcttacttcttacgtagcttggctgtgtcactattttagcttgtatattcccttaggagaatttttaaaatttccttaaacgtcagtcaaatctgctgttttaacaaatgtataggtagatggaactcaacaacctgcccatttataaacactcaggcttatccaaaatcatcaagaattttttttaccttgacctaaactagatacaataatccttatctgaataggaagtttgggtgatttatttttctccttttaaatggaaatttctcaaagcatatttttctctgatcagtataattttacgtataggaattagagattttaggtggctccaaaatctgtagaaatgtgtgtatcaagtaccccaagtacctcccatgtggaggaaggacttaaattttctgtcaaattgggaaatagatacattcttcacttgggacaccgatatactaacaatccttctgacatgcttagaattacaagatctttattcatttttaatgtctttctctgcaaccaacataacaaaacagtctagatatattcatttatcctttcccccttactttacaaagttgtatcaagattactggggtgaatttttctaccagtagctcccctgggtctgtctaaacttcttggattgtgagtctatttgaaactgggtcttagtcttcaaatctgtacctccgtacttcacgtaacctggctgaaactggctctgtccagagtttgaagtatgatgatatgggctctccaggctaaatagatattggtagaggaagaaacagatgctggtacatcagaatacctgggatatctgggatatcggaatacctgggatatcttcacatgcatagatgctggtacatcagaatacctgggaagaatgatcagtgatatctatcatatgagactggtgactgctttgggaatgaaaggaggaacctgtttagccggtaaggtggggctaggttgtggaaggcccggttagcagcagtggggagatactgtagctctgaacagagagtgacatgatcagggtgtatctagagtgactactgtttgagtgccatcctggggactagactgtgtggcaggatgtgctgggctttggtcacccatcatccactctcccaggctccctctgaggagccatgcctgctctatgctcagtttgtatgtttttttggtgtgtggcgtactgccaatccagctacccaaatcatgtcatttcatgaccacactgaatggtttaggggtaagcgtgtgaccaagtgagatgcagtgatacttggcttgggctccaagaagggcagctggcgcttttcttcatggccatggatgtggcaggagatgggacaggggcaactggagccatcatgagcagagcctgctgagagccagcaatgagggcccagccaagagtttgagggtgaggagctgagtgttttcagcccatctccccttctgaagccagccctatcactgacctttgtagacgtatgatccaataaaagcccttttggctcaagccatatgaggttgagatttctgtctcttgctcctataagagtcctaggagatagaggtggaatcagatcatctgtgggcagtattaccagttaggaactttttgttttgtttttgagacaaggtctcactctgctgcccagcctgcaatgcagtggcatgatcacggcccactgcagccttgacctccctggctcaagtgatctgccctctttagccctctgattagctgggactataggcatgtgccaccatgcttggctaatttttaaatttttttggtagagacagggtctcactgcatgatctggactggtctctaactcctgggctcaagcagtcctcctgcctcaggctcccaaagtgctgggattacaagtgtgagccactgctcctggccaggagagtctgataaatagtctgggtgcctggcacagagcaggcactccacaatttagcagatttaattaattaaattaaaagggcttaaattgatgggcagcagctgtctaattttcacaaggttctttcacaagtagcttgctttgtattgtattgactattaggccattctcacattggtataaataaatatctgagaccgggtaatttatgaagaaaagaggtttaattggctcatggttccaaagtttgtactggaggcatggtggcatctgctgccgggaggccacaggaaacacaatcatggtggaaggttaagagggagcagatacttcttacatggtaggagcaggagcaagacagagacagggtaggtgctgtacccttttaaacaaccacatctcctgagaatgaactcaccatcgtgaggacagtactatattagtgtgttctcatgctgctaattaagacatacccgcgattgggtaatttataaagggaagaggcttaatggactcacagttctacatggctgggaaggcctcacaatcgtggcggaagacgaaggcagagcaaagagacttcttacgtggtggtgggcaagagagaaggcttatgcagggaagctccctttataaaaccatcagatgtcatgaggcgtattcactatcacgagaacagtccaggaatgacccagccccatgattcagttacctcccaccaggtccctcccacggcatgcggggattgggagagctacaattgaagatgagatttgcgtggggacacagccaaaccatatcaagtaccaagagggatggtgccgagccattcaggagaaactgccccatgatcaaatcacctcccaccaggccccacctccaacactgggggttacaatttgacgtgaaatttggatggggacacagatccaaacgatatcaactatattaactatgtttttgaaataacttagtttcacagcagaatgcagtttttgaagaattaattgttttaggcagcttgagaataggattctttgcatgcctcccagatatatccctgtgtgtgcatcccaccagcattttttcttcattataccagaggtatctaagggatttcgtgaaaggtagagtctctgttacttctggttatgtgtcatatattttcttggattatgctcaattcttctctaatctctgatgtttgaataaaatagtcctgggaaaagactttcaatggttttttagctgtagaaagattaaatactccttttggaaaaacagttgacgttctttatttctctgtcaaaaggctgaatttaaaaactcctgaagcttcatggttgccaccttttgtttcagtaactttatgtaaataggaaaaaagtgctttctttttaaattggaaaaaccaaatgccctttttctgtaattataagagatcatggcaattctacattgtttggagaatttgctatagcttcagtttttcttcttgtatgtcagagtactttgccagctataattgggtagtttatattttttgcatactctattgtttctgtgagtttcacacaggagaaatgaagttgtggacatgaggtgggagcaagaagtaaaactctgaagtctgtgttatggatatgtttgttaataattatttatttatttattttttagagttagggtctcactctgtcatccaggctggaaggcagtggcacgatcatgtctgactataacctcaaactcctgggctcaaaccatctgcccacttcagcctcctaagtagctgggcctacaggtgcctgccactatgcctagatattattttattttgtgtagagatggggatctcatcttgttgcccaggctggtctcgaactgtcggcctcaagtgatcttcctgcctcagcctcctaaagttctgggattatgggtatgagccactatgcccagccaataacaattattttttaataactagtgagatgtatgcttttttcccctctctcacacatgcagttagttacagatgggatcatttgtccaggaactctgaactccaacttgaaacatctttttttagcaaccattatacagacagtgacacctgtcataaataaaaatgacttgagaatttctatatggtagatgtttctataattactgcattgctggttagaagtggggcttggttcctgcatggttcctccaaagctgcaggaggcctttgaacctttcgatttgaaacatgctggtgcacacttcagagctccgcccagagaatccctcgaccaccgggagaaccgagtctttcggggatttgcccctccagacaagagaaatgagcaagcagggaggtcacatggccagccaagctggtctgtaccagataccaaatcttttagctgtagctagagcatttaacttgttaaacatattcctctctaactgaaatctcagggacgatggaggagagactgttgagccaggatgtttttccttcatttgcaatattagacccagactgaagtggtcaggtatgggagagatccagggaagtggacacttctggtttgaaatctggctctgccactttctagatgcgaggcttgggcagttgattgatttttcatgctcttcatgtctttgtctcagctaaggttagaagtagcatgtggataatacctagcacagtatctgatgcgcagtagttgtgtggtcagtggtaaaagtattttcgttgttgttattacccttcctcctcttgctccctctgcttgagggaagggttaaaaggaacgcaccacagttacgctgcctcctttgccataagcttttctgaaaaattcatcctggattgcctggatttggcatcagcacttagttaagtagggactgagagggtgggcactgtttaaaggtaaaactgatgcccagaaccatcctcccaaccttggtatctaagagcggctcccttccctgggaccttccacaccccccaggtggtggatgtgtcttatctgagctgccaacaggccctgggatcccggcccccccatatctcggaggaacaccagccgctctcaagacattctgtcctgacagtttggtgccctgtgagtgcttcttacagccaatgccctgcaccctcactgcattctcctaatcactgtgctaattactgcacaatgtaatagaactacattaactgttgtgtattttaaagtgcaatattaatgttcatttttgtgcttgacacctgcacattttgtggctcatataacatttctactcacagtggaagaacattgagaaaaaaaggactctgtctgaatttttagcttctcattactgtagtggtctcaaattttgtttctgcacaaggtctccttatcactcaggcactttctgaccaaggggtgggtatttcatttgagacactaagattgttctgcatgccgtgtagcgtgaatatcaacattaaagattgcaaaaagaaaagaagatggatggacggatggatgtgctaaatagattttaaaataaagtcaaatgaaagtctttatttttgagtacagcaagacgcttcatcaattcagttttaaatccaaatgatacttaattatgagagacagaaataactcaggaaatgttaccaagtgctctagggtttctagccagtgatttcctaactccccaagagaagcaaaaaagaagaagagctcgagatggggaaggaatctggaaaatgaaaaagagccactgtggctgggcagcttgttcctccaggctggtgggcttggtgccctcggccttgggatgcttatcacagtcctttgggaccagaacactggatatcagtgcagcctctgggccagcttcagaggctgttagagcatcattgctgctgtggctgatgcttcctttcctcagtaagtcacaaaagtcgtgttggccatccaggttaccgagtgacttaatttccagaaaatttaatattgagtcattattgtatgcattttcactgttgccattttgtatcctcgtaggtagtctatgaagtaccactgggtcacagctgcagtctgctagaaaggagagagacattaaagaccctttagatcccttatagaagtcaaaatgcagggataatgtctaaactgcctgctcccagcagttcaatttcagaaccagaaccagagcccaggcctcttgactcacaaatacttttcttttcatgttggtagagttagaaaatgtcatgataccaattttagcacaacaaactatttatctagctgcttttcttagattagaacataaacttgtctttggttttggctgctgcagagattttgatttctctctgttaaacagtccctggatctcttcccccagatgactgacagtgatctggagcctgatttatatggttttgaggacttggtctttggcctgagaaaagccggtagccagtgccactgctttctgtccttttcaatgactggcaccccggccctgcactttggattcctcatcctacggagcaactttacttacccaaatagtctgagatgattctggaaccctgaatgttcagcacttcaatatttgacctgcaggatagaaagacccacattctactaagattgaaattcgaaggtggcacaatagaggatcactgaagaaaggctctgactctcggtgatttatgaggtcttcctgacgcccaggcagtgaagggaaggccaaggaggacctatgttgggccgccagtgtggcctcctcagacctggaagtgcggtggtggggcccagggttttgactgagcgttttcagccttggcctagaaaagatgatgaaacccttttttcccctcagtctaaccccaacagaggaagaacaggaattcaaaaaagccattaaactggggcatagtcttttccattgaatctataagattcttgaagatagacaaagatgctaccttgttcacccttttgcttttttttgcggaacctgacacagtgccacacataggcatctttttgaatggaattagatgtttagtgttctgtctctttcattagttctgagaatacccgaagtctgctagtgtcaatctttgggctcttgtatccattgccaagctttttgtttttgggtttatctaaaagaataatattgtgatagtggtttgtgaatatagttttacagtataattttgtcttaaagcattctattttcaagtactaatttcatgtataagatttcttacaataattattaactgtctatgctaaacatattaattttgaataacaattctacaatgacctcaaaggcatttacaagtgctcaccacagccatggtgaaggatgaacgtggctttgaagttagacagaccttagctctagcacgggtgtcctgccctttgaatttgaggatgtttttgcctgtctgtggtggtggatatcatgaaaattatgcatggtcctttttttttttttaagctcatcagctgttgttagtgtattttacgtgtgtggtatggcccaatacagttcgtcttcttccagtgtggctcagggaagccgaaaggttggagacccatgctggccgggccacgccacctgttccctgcaggatctgggaaagtttgtcaagtctcaagttcaacagaactatgaaatggggattatgcaagaacctataattcagggggttactgtggggattaacttgagctcaggtatatagagtgattgtgcagtgcatggatgtcgaatatcaaaaaatatttgttattgtttttattgttatttggtgatttttcataaacaaactgacaactggggttggcctgattcatgagatattggtggagttctttgaaatgccccagttctcttaccttcagaagtccaaagctttccacagaatttctgccagttcccatggaggtttgcattttcacagtcccttctggcataatcatttgctgctgaattagttcacgttgcagatcgactcaccatccgtttatgtgtcattgtcttgtggcacagctcttccttaattacctagctcttccttaattactctcccctcctccaaaccctcagtgcgttatggtatatagccaactgttctgaagattttggcaaaggaagggttgatactgcaatgaaacggtgccttcagacagtttagattagatttgttcactccatccctggagattatttcctgtggtgcttcactacctaattaaaaaaacaaaaacaaaaacaaacaatcaaaaaaccccaaaaacacttaacatgaggtataggcatttttcccaaaagactaacagtgcttgtgttggattatggtcctaggggtgattttcttctcttcctgttatatttccaaatctttaaacattaagtaaataagtacatgtttcctagttttaaaaaggcaagttctaaaagctgggggcgaaagtttgttaggattggagaagcaatacaagcaggataaacaaatctttgctcagcgatccccatctccttctaatcctttaaaatgtatttctcaatccggcctaatggagtcattttatttcccgtgtgtatcacaagtgcagatgccccggttggtagcactaacaggcatctttccttcaaatgtcttgacgtgccagttgcttctgaaaagctaacgtggctcttgctgctccggggtggagttcgcgtggtcagactatctgcttctgcccgctcaaaccccactttggcaaagagtggtatctactttctcagtgcctgggagttgacacctcaagctgctctttcatgggttatgatcctcatgcttccaggacccctcctgctaagaccaccagtgcccccatgttcctgaatgtagtgggccacttacagttcttgccttactccatctcagcagcatttgacatagacactccctctctcttaaaatattatctctgctatcctcttgatagcagaatctcctgattgtcctcctgcctgtccatttctttgtttctgtgcttttctgattcctcttcttcatgtagacctttaaacattgggctttcctcagatctcttctcactctgcctgctcgccctgggtaaccttttttagtcccatggcttcaattattatcttttatgtgctaaagactaaatttatcacatttcaacaaatctaagacatcagtgatgctaagaggcagcaagattttatgaaccacaaaagaagaaagaagcactgccaatgaaatgacacaatagctttttacacatcagtcatcagatgtgtcccatttttagaaataccagaatgtaaaaaatgtacatccaagaattaataatatagtgtaatatcttttgcatagatttccatagcctttttcagagtatgaatacctcgtatgtcttaagcatagtgctcctgggagcaggcaaatgagttgcaacaattttgttttgagaagctggttgtttccttagtcttagctctccctaagtataaaactggccttattactttgtagtatgtacagcatatatgtatagatgagacagaattaagttagcccaacagtaaggctgaattactgagtcagtgggtcttcaagatggtgcccaaactctgaaatttatttcattttagatcgttttcaacgtcttagtataaactgtgaggtggtccctgaacagtgctttctgacttcataacgtttctaagacaactgaattttaatttttataattcatttttaattgttagtatctctgggaaatcatactgttggtgttcccctccttatttcttttttccctctctgtatcttcaaaattacttttgacagctctgggacctgtaggaactattgccaaattttggaatgtgactttcctgcagcagcatccaaagttaacaaaaagacatggaaaaatcccatctcaatggtagtattctaatctctcaacatctgcataccttattctgctccactgagcttttctaaaaataatttaagtgatacagcttcctctacttctgtagggagaataatccatatcaaatatttttgcctcaaagtattatcttatgctcaatatgattatctcaataaagtttctatccccttatttttctcctcccatactttcataatatctttatcgtagttactttaaaatagaatgtttaatgacaaaagtttaagtaaaatatcccaaccatatgagaatttggaaaatgcttcccttaaaaactttcaggtcaaagaagaaataaaaagtgcaattatagaccatctagaaagaagaatgaggatactatgaataatattcacaggataaaacctgagatatacttggaggaaaatgattgaatttaaaaacttttgttattaaacaaaaagaatgacagttaacaaactgactgtgaaatctgaaaatttagaaacagacagacaaaaaccacatggcatgcccaagcaaagcaagttaaaacatttattaaggaaccagaaattaacaaagtagaaaagaaaaataaagttgatatatccaacacctgttactttaaagaaaaacctttgcctgtctaatcacaaagaggtaaaaagaaaacaattcacagtattaggaatgagggaagggataagaagagaggggtttacccacagataagaattaaaagattgtaaaaatttgaaaatctgcagtaagataatttgtaaaggtattataatattaaaatgggatttagtaaaaattggaaacagtgaacggatctgtaaccacataagaagttgaaaccattactaaagatttctgtgtaaagaagtactatacttgtttcaactaataaatactttgtatgttgaaagcttcctgattaattgatgtaatcataaccatggttaattcacttgataacagcagcatgaataggctagggcatggaggttctctcttaaaagtatagatgcaaaagaaaaaaaacaaatcaaaataacaattatggcgggaaaaatacaaggaattaaaatatcaatatataatgactgtgtatgaattacgtagtcgtgatttcaagttggccatatagcaggaacacaagactcctttaaagattaggaaatctattactattattgataatttagggctagagttaaaaaaacaaatatttatccaaatacatatcaaaaaggcataactttcacttctgattttaaaaaatcaaaactcttagtaaactaggattaggtcactttcacgatgcgataataaatatcagcatgaaactcaatggtaaaagataataagtgttccattaaaaatgggtgcacataaagagatgctcaatattgttagctatcagggaagtgcaaatcaaaaccacaatgagatcgcatattaggatgactataatcaaaaaaagagattataataagtgttatcaaggatgtggagaagttggaacccttgtatattggtggtaggaatattaaatggcacagctgctttggaaaatagtccagaagctcttcaaaagccttactatatgacttaccaaatgacccagcaattctgctcctaagtatagccaagataaatgaaagcatatgtccatacaaaaacttatgctcaaaagtacatagcagcattattcctggtagtcaaaaggtagatgcaactgaaatgtctatcaactgatgaattggtaaatgaaatatgatatgtccctataatggtatatcatggggcaacaaaaagtaaagcactggtacattctatgaatagatgaacttggattgaaacgtagattgagaacatgattgctaagtgaaagaaaccactatcaaagtatgacatgttgtatgattctgtttatacaaaatgttcagaataggcaaatctatagagacagagggtaaattgatttttttagggccggagtggttgggggaataactgggatgtgactggtagtgggtgcaggatttctttttgcggtgatgaaaatgttttaaaatagtgcgttaatgtttgcacagtggcagtgtatacagtgttgtgaatgtgctaaaaaccattgaatagtacatttaaatgggtgaaccgtatggtatatgagttatatctcaacagagctgtcattcaacaaaggaaaaacaatgcaagagtgactgtagtctccatgctatttatagttactctgaagtttctaattaatgctattatacaaggaaaaaagataaatattggaaaggaagcaacacattattacagaaaatatttggctactcagaacattcaagagattcatactagaattaatttttaaaagtttggtaaggacgcagttataaaaactcattgggccttgggctactagccttactgtataaacaggtcttataaatatgtaagaaatgctgatcacccagtagcaaagtaaaccagtgatatgaagaccattcacaaaaaatacaccatgatggataaccatacaaaagaatgtgcagcatatcagtaacaaaagaattcttgtaaaaaaaaaaaaaaaacataagctagtaggtgaagggcactgttgtcgaatgtatgcctttaacatacatagactttcacaagtcctcaggaatttcacaatgctccagagtaaattgtataagtacagatatttataatacctaattctttattgacctcagtagatctctgaaaactgggaggaagtgagatgggaccctctagagctactcctagagggctggcttggctctaagggcttagaggagactgaggcaatgggaggtcttgggtcctgtttgctcttggtgttttgaggaatgttcacgaggtctgctactcccctggctctcccttggagtagatgggaagtctgagactcccaaactagatcaggaccacacctcctattatttattcatttttgagaaggagttttgctcttgttgcccagactggggtgcagtggtgcgatctcggctcactgcaacctctgccttccagttgtaagcagttatcctgccgcagccttccgagtggatgggattataggtgccgggcaccacgcctggctaatttttgtatttttagtagagacggggtttcaccatgttggccaggctggtcttgaactcccgacctcatgatcaaagtgctgggattacaggcgtgagccaccgtgcctggcctatttattttttttgagatggagtctcactctgtcacccaggctggagttcagtggcacgatcttggctcactgcaacctctgcctccagggttcaagtgattttcctgcctcagcctcccgagtagctgggattgcaggcacctgctaccaccccaggctagtttttatgcttttattttattttatttatttatttatttattttgagatggagtctcactctgtcgccaggctacggtacggtggcgcaatctcagcgcactgcaacctccgcctcctgggttcaagcgattctcctgcctcatactcctgagtagctgggactacaggcacccaccaacacacccggctaatttctgtatttttagtagatacagggtttcaccatgttggccaggatggtctcgatctctttacctcgtgatccacctgcctcggcctcccaaagtgctgggattacaggcgtgagccaccgctcccggccaatttttgtatttttagtagagacgtgggatttcaccacgttggccaggctggtcttgaactcctcacctcaggtgatccactcgcctcggcttcccaaagtgctgggattacagatgtgaggcactgcaccggcccacagcttctatttaaactgaagaatggagcgaatacaatgcgttagttcctaagctgcatggaagcaaataccattttggcttgagggatgagtcagtgtttctctgcaggtggttgatccttggcagtggtaggattgctgtgcgctgtggtcattacaggaatgttcctctggtggttatggtggctgtgtcttactagaattaccattgcttcagttttctctcgctctgtagagattgtcttgtcatttccattacatttcatgttaggatgatctcagtgcacatgtccttaaaattggtctgcatatgagagaggtatgctttgtaaaaattgtttccagaaatctcttctagcagtttggattttagctgagtggtgataatgccattcattaggaagattttgttataaatgaatgtaaggatcttgagatggtatgttttccacatttctctgatacttttttctcccgtatgtatgtttatacttgctactagtttgtatggaagcaaagagccttaaggccatttctacaagctagaaacacataggaaaatgtgcttttttctttttcatagaatgtaattgatacatagtgtaaactcagaacattaacacatacactttctgctttaaattagaaatgtaatataattataatgaaatgaaagcgttgaccattgtaaaacccagagagggtattcttaataggatctacacatcttttgtggtacctttaaactcatattttcgtaactggtgaatgttcatcttttaatatacacaatcctactctgagatccgattaacttaaggggaagtttttggtttttattattgggggaattctcaaaaaattgtattttggagtaagtgtgagtttaccctgttatcatttatttcgtgaattgctcttctgctttacggtaactcttttcatcatgccgatttctctaggttgaaaatgtccgcttggtagatcgagtgtctcctaaaaaagcagctctaggtactttgtatttgacggctacccatgtcatattcgtggaaaattcacctgacccaagaaaagaaacatgggtatgctttctttatttttagctttccttgttttgcgttgtttgaagcaaaaagtgtttgccctccattcatttttcctcagggtgagatgggtgggcttttgtgcctggatgttggggaactgtttctggaatgtgtgtttggactttttctgtgcagtcgtatctacttgatcgactattcattttaaacatgaattatttgaacatcagtgaagagagacttagaactagccagaagatacaagtgcttcctgtcacagctgtcaaggagagattcaataatgtcagtaggccagattcagcattgtcatcctccagtgctccatttgcaatagtctctatttgcagggtcctgtaatgcagccatttggtcattttattacattgcctctacttttctgataattttaaaaagaaagaaaatctagaggagcttcatcatcaggtatttctcctacttattaatgaaaccattagatatttgaacatcactaaataataataattattattattaatattatttttgagatggagtcttactctgttgcccaggctggagtgcagtgatgcgatctcagctcactgcagcctctgcctcctgggttcaagtgattctcctgcctcagcctcctgagtagctgggactacagtcacgcgccaccacgcctggctgacttttttgtgtttttagtagaggcagggtttcactatgttgtccaggctggcctcaaactcctgacctgacctcaagtgatctgcccaccttggccttccaaagtactgggattacaggcatgagccaccgtgtgtggccttattattctttcagcaacccaatcatgacatccctgaattgtagatttccctttgctgtatttcgtgcacagtggtacatttttagcagaaggtggcaggcacttcttagtggaggggaaacttaaagattaaaatgctgctattgaagactgagcatagaccctcctgtaacaccagagatgcacttcagtatgatttcctttaaagttaatctcctctttagagagtagaatgatggttttaccagaggctgggagtgcagaggagggggagggaatgaggagatattgattgaagggcacaaagtttccaaaagacaggaggaaaagtctggaaatctattgcacagcaaggtgaccatactcaatagtaatgtatatttcaaaataattatgagagtaaatttcaagggtctcactgtaaaaaaaaaaaaaaaaaaaaaaaactataggtaagtgatggccatgctcattagcttgatttaatcattccgtatgatgtacatatatcacagcatcacactgtagcccataaatgtgtacaactatgatttgcaataaaaatattaatttaaaaaataaaaagataaaataaatcccttcttttgcagcctgcccgaccaccaacagcttagaaaacaacaatcccatgttgatacagaactcgaacattccatgtggaattaaggagcatggtggcacctcccagcggagccatctctaacttgtgttgactgcagaagtttattttactaacttctcatgaccttatttaattttagctattaagcgcattcaatatttgactaccaaaatgtttccatacctggacttgtgcaaatttatatgctgaatggtttacttcaaaataactgtcctggatatcaggaagcttggtattgaaaaataaaattataaatttaggaagttggttcttacctggaacatctcagtgcttgtcatctgaacgcaagggttgagctagctggaggttggggagcgtttcttgtctttctttgagccacaaagaaatgttagtccttgtcgtattcattagttatttgtgcttagcttatgcacattaacatttggttctagattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccaggtagggcagaggaactcggcatttaatatggaacctctcttaaaaatttgcaaatcagattcaagaatttgtatggtgcttaggaatgataggggttcagggattatgtgtcagtctcgttctcaggagaggataagcccgaatgatcatctgatacagagtttcttgtttttttagagtctcccccgagttatttattatgtgagtctctttcatgaatcttagtattaacttaatcttggtggggttataggatgctttccttttggggtgaaattgcctttaagttatgcacttcttatattgtggtaatcgagccaccttgaatggggccagtgacagaactaatcagttgttttgtgtggaaaatgttatcagacagttctagcgcagttttctccctcttgatgcttttaaggtttggtctccattgcttttttgtttcttggggttttggttttttttttttttttttttttttttgaggcactttttctccgtcgcccaggctggaagtgcagtggtgcaatctcagctcactgcaacctctgcctcctggtgcaatctcagctcactgcaacctctgcctcctgggttcaagcgattctcatgccttagcctcccaagtagctggactacaggtgcccaccaccacaccctgctaatttttgtatttttagtagaggtggggttttgccatgttggccaggctggtcttgaactcgtggcctcaagtaatctacctgcctcggcctcaagtgctcggattacaggagtgaactaccatgcctgcacctccattgctttttgataataatttattttttccaaggttgatacaactagactagcatcagtgactattcagggtatggatctgctgattctcctggaaaaaaaaaaaaaaacttaatgtggtaggaagaacatttggatttgaaaaatatgttcttgccattgctatcttgttccagccgtcatcttgggctcttcggatttatagcttactgttcgcttctacagaagtgtttcttgcctctctgtgtggcttgtgtgagttgtggtgttgttttccttaaaagaaatatactcggcctgacgcggtggctcacatctgtaatcccagcactttgggaggccgaggcaggcggattgcaaagtcaggagactgagaccatcctggctaagacggcgaaaccccgtctctactaaaaatacaaaaaattagctgggcgtggcagtgtgcgcctgtagtcccagctacttgggaggctgaggcaggaggatggcgtgaacctgggaggtgaaggttgcagagagctgagatcttgccactgcactccagcctgggtgacagaacgagactctgtttcaaaaaaaaaaaaaaaaaaaaaagaaaaaaagaaatatactctactatactctaagtttcttggaagaatacagtgaaaagagatcatttatatagaagttgtgctacacagaagtagttaataaaggaaataagatatgtgctgataattactttgccaaatgctttttgattcaggacaagaagttcaattatgaacttttcaaggcatttggttggatcctaagtttcttatgatttgtccatattctttgtaggtagctaagagctaaagttactaaatggaaatgacgccagggagctgtcaaaatctggtagtttttactttgcactgttactctttaaaggcagttggttgaggctttttcatccaagtgtgttaaaagaaaggcagagtaaggcagaaaagcagttgaactttttggagggtgcactaaaattggaacagaagttctgggaagatgtacattaggttgcacgcagcagataatgtgaggagaattctgtgctaacagtttctgtgtcactgattaatggaagtactaggcgataaatgtgctctgagcggattaatgggatttaggaatagcccagcgaactgggaaagggctgagcagctggtgatgagtgaatcacagggaccaggagggtcatggcccagagatagcgagtgccaggactctcgccgtgaggatccctgagggggaaattactgtgttccctcattttcgaaaagagatactttttccttaaaagatgaagggagttaggtattagatgtagacagagatctgactggctaccttttctaaaagaaatcatagtcattcactgaatcaaagccatcacctaagaggagttaaaaagaatcaccagcattttgaaacatgggcattagaaatgccagtttgcctaaaatgtagtgctttaataagtgtggaaggtgaaacagatcacaagcagttcacagtgtaatgttaaaggcattgctaacattagggcatattataggctgtaactttggaagcaggactttgactctggagggagatggggaaatgtggaaggggttagacatgaaacagttgccttcaactgggggatggggtggtctttcagaaccatctgaagatattttataaaagacaccgtccactgcctttaagggcatgagaataagggtgtgtgtgtagttggtgagggaggtgtactttgaattctagtagtaaaatgtagctctctcgatattctggttagtcaccaacaaagttcacatattttcagtttatttatggacacccagctaactgtaaggttctgtagagcaggggtccccaacccctgggccgcagacaggtaccagtctatggcgggttaggaagcgggcggcacagcacagcaggaggtgagtggcgggcgtgcaagcgtgagctctacctcctgtgagatcactcgtggcattaattctcttaggagcatgaactctattgtgaaccgtacatgcgagggatctaggttgtgtgctcctgatgatctgaggtggaagagtttcatcctgaaactatcccccaaccccacacccccatccacagaaaaattgtcttccacaaagctggtccctggtaccgaaaaggttgtggaccgctgctacagaggacaaaacagttgttttttacataagaagaaatgtttgggaattcatttaagtcaaggtctctgaaggagatattttcaaagctgtcgtaatttaatattaaaatcaaaagtactttaaaaatagaaaaaaaaaaaaaaaaccccaaaccttagcatcagcagaatgcgaagggtggggaagggaagagaaaagtttccagctgttagcagagggacacagaggtgtgaggtgttttagaaccggtgtaactattgaaagggaaattgcttcagacattctgctgaattcaggcaacttaaaataaatgtcgagattatctctttactgagttaggatttctggtataaggtaaatcaaattattaaaaaattagagactttattggtttgctttttgtgtgaataaagattgataacaatttggtcacagactgtagaagatctcaggcaaaacataacatgcccaaatgcaggaagctgtttcattcttggtaaagaactaagttaggttaaaataagggttgtgggtcaaatgagatcagttaaccttgtagatctaatgtattaataaggattgaacttttctgatgaaaagacccgtttctcagaggccttcagcttttcccatgtcctctctcctctcttccctccaatttgcctcctgctgtttatttttgtatcaattatcttcccctccttagtgtttgtgggtacttcaacacttaaataatttcttttgtttgttttcccccttttcctaaactagtttctttttagtattttagtccccagttcttttggatattttttattttagaaaaaatctcatgattgaagtagtctcatttgctttattggtaactttttatattccttatataagtcattgatgtttaagcaatctttgcagtggtaatttcttttttatcagagcgtagcagcccttttccactgtgttagctttaacagtcctaatatttaatttcaacacttgtttgcttaaaacaagacagataaggtgaggcaccctcatttttattttaaatatgcaaaatccagtaatagctgtattatcttctcaccccactctaaatggtttttcagctacagtttttttttttttgagatggagtctcgctctgtcatccaggctggagtgcagtggctcgatctcggctcactgcaagctccacctctcaggttcatgccattcttctgcctcaacctcccgagtagctgggactacaggcacccgccaccacgcccggttaattttttgtatttttagtagagacagggtttcaccgtgttcactaggatggtctcgacctcctgacctcatgatccgcccgcctcggcctcccaaagtgctgggattacaggcgtgagccaccgcgcccggcctcaactacagttattttaagttgcctgaattcagcataatgtttgatgcaatttagctttcagtagttactttggttattaaaaaaaatgctcacatctctgtgtcctgatgactgttggtaagttttcccttccctttcccacccttcccattctgctgatgctgattcatgtttgttttttcttttcatttttaaaatacttttgattttaatattacattatttattgcttctcccagttagtctgtaatgagaggcaattactccatatatttatcctaaatattctgtttttataacctttaacttgatacctagggaacaagctaggttattttccttccttccctaatgttttgttgtaccctcatctctcccttatttggcagaaggagcaccctttcctttatatgggagagaaggagcaaaggttgtatacggatgcagccccatttattcacctggtggttccaagttgagagtttgtacctgatgtcttgcattttctatgggaagtaggaagtggggttatctgagagtgaaggagccgaggagagcaatagagactgagctgcactgtagtgccctaggcttccctaggttaaggggagcacaatgaacaccggtgctagaataagatcagccaaaacatggatctctgtgtttgggttgagctcatgctttcaactgaaacactgatttggtcttcctagaaacagccaaactgttactcatccttaatttcgtgtagtattttagaaattatcattttgctttctgggtagaaaaacattaaagctggactcctgtttcattagttatatgatttaattagataatatatgatactgtaaataccaagatttccacttaactttttctgaatgttttttaaaaattaaaggtgcacattcagtttactcccacagtccaaaggcattttgagtatttgcttcttattggaggagctcttgtgtaatggggccccttagggtgaggccttcgttgcacttcctgctgaaagctgctggtcactaacagcaaaagatgttttagttggatatgctggcttagactgtgatgggaaaagccagaggagcttttaacatgcctgttttaagagtgggtagaaaatcaggtgagggatatgaccttcctagagtgggcaaatattttctctctgttcagattctgtaaatattaaagatttgtctaaaatataagaagcttctgcataacaaaggaaattgaagaaaagacttggaagccatatacctgataaaggattaatacccaaaatatgtcaggaactcaaacaactctataggaaaaaaaacaagtactctgattaagaaaaggacaagggacctcaagagacattactcaaaagaagacatagatggctaacagatacatgaacaaacgctcaacctcaataatcattagggagatgcaaattaaaaccacagtgaggtatcgcctcacaactgttagaatgacctttaccaaaaagatggaagacaacaaagctttggcaagggtggggaggaaagagaatgcttatgcactgttggtgggaatgtaaattagtacaagccattatggaaaacagatggaggttccacaacaaacaaaaaatagaattatcgtatgattccacaatcccacttttgagtgcttactggaaagattgaaatcggtaagttaaagaaacgtctgctctcacattttcgttgcagcactattcacagtagccacgttgtggaatcaacttaagtatccatcattggatgaagagataaagaaaacatggtatatacaaataatggaatgctattcagccttaaaaaggaagacattgtgttatttgtgacaacatggatggaattagagagcattatgctgagtgaaaaaagccaaacataacaaataccatatgttctcacttacatgtgggatctatgacagttaaactcatagaagcagagagtagaatggtggttaccagaggctgggggtgggggacgtggggagatgatggtcaaaggctgcaaagcctcaggcaggaggaataagtctcattattttgaaatctgttgcacagtgtgttgagtataggtaatagttcagtagtgtacatttcgaaacgctaagagtaaatttcagatgttctcgttacaaaaaatgttaaatacttgaggcaatgtatatgttaattagcttgaattaatcattccacattgtagtcaaaaatcataacatcactttttgaccgggcgcggtggctcacgcctgtgatcccagcactttgggaagccgaggcgggcagatcacaaggtcaggagatcgagaccatcttggctaacacagtgaaaacccgtctctactaaaaaaaaatgcaaaaaattagccgggcgtggtggcgggctcctgtagtcccagctactccggaggctgaggcaggagaatggcgtgaacccgggaggcggagcttgcagtgagccgagatcgcgccactgcactccagcctgggcgacagagcgagactccgtctgaaaaaaaaaaaaaaaaaaaaaaaaaataatagcaacactttttaccccagaaatatatgaaactgtaattcatcaatatattattaaaaagtctgtaagcaaaaaaaaaaaaggattgtcaagccctaggttttttttttttaagcttgcctcccagctaattgctaaacattctgctaaatatttggtaaaagtagagaacgaaaagaacagaaaattatgacatgggaacaattcagtaaaactttcatctgtgctagtggcgcttttcgatttcttagagtaggcagagtctgcaggctgtatctgggcttgcctgtgggtaagaagcttgcccatattgacatgactgttggctgacaaaaatgggcttttcctggccctcgtgtacaattttccttaaattgggcataaggattggttgatcacccttttccttaaaaaagggaaaatttcataatttcagtgtcaacccatcctaaggtctcctagttcaacagtgatctgcttaatgtctgttataaattattcttgctgtaatttatggataatttcgttgcctcttcccagtggaaacaggtatcagcccacacgcagaaaactgtcagtagtcataggatgtttttcttcttctacctttaaagctatttgtaaatatttaacaaagagaacttaactgccattattaccccatattcagtagctcttctttcactcagggaactgaggctttctcaagagattcctttggcatcctaaacaacttgcatttgtggttaacattatggtagcagaagcctgagtcatgaaaatggtacttagagatggaaaagatgtgtcaatgttgagccaactgttcccagaacaggatctgaggtttcacatgctgtcagcaacattagctaagatgataagaaattgattttacggaacgcgtctgctctggtttgtgtgtgagcacgcctggatgtgcgtattttgttatttgtccaaatagtccgtactctaagttttgaagtttagaaacatgacatggagaaagactgaaatagaatataatttatctcactgacatacagcagttgcttcttactctcaagaaaaatgaagaaatctggtgcttaaaatatgacccttatctttcctcttccatgcagatgagtcatctcaagtttgaaacctgagttttcatgtcaggctgcctgtgtgttgctgcagcctcttgctggtggcaagattctataaagggctacacatacatgtatttaggaaacttaaattgttcacactgaatactatcactatgctaaggacataggaggacctaggaaagctatgagaaagaagtatattggagaaaaacaggaagattaggggcctggaacgaggaaggaagaagaagagagaaggatctgcgtttggggagggtgtgttacaattaggagcaggccttctgcagccagatgtctcatttaaacctggactctccggtaactggctgtgtgactctgagggagggagtgtgcctcccgtttgcgtcagatttctcgtcggtaaaatgaggaccatcaatgttgcctactaactggattaatgcacttaattgcgacagaatctggaacaaaacaaggtctgagtatcagttatcctttattatcatcagaaatgcttagatctgcactgtccaaggtggtagccactggccacagatagctgttcagcgctactgcaaactgaggtatgcggttaagtgccaaatacatgtgaaatttcaaagacagcacaaaacaaaatgtatcaaatattagtaagttttatatcatgcacatgttgaagtgataatgattttggatatattgggctaaataaaatagattgttaaattaatttaacttttttttaatgtggctacaaggacatttaaaatgacatacatagctcacattatatttctgttggatagcgctggtctctacacttcccttaaatggcaagagcagagcaagaaaatcaaatcctagattttagtggagagagggaaacagtggggctattgggcttcacaagcatcaaaggcagtatataaagacagagataacacgacaggattgaaagaaaccacatcatgatgcagccttcaattcgcatcccacgagcacagcgctgtgcagtatgaattgattttttttatgaatcttatgcaaatgagcagcacaattacgatatttatgtagttgtttaaagttcagatgtttccaatgcaaacgtttagtatattccagagttttttcaactttattatttttttcttttttaaccctgtgagcatcaaaatgtgcaattggcctgggccttgtgtctgcctctgagaggccatcccaaatccaagcttgataggcattaaaaaaatggaatcttcatgcctaatgaatgcatatgttcttaatttttatgttccatatttgatgtggtctggaaaatatatttgcttttaaagcaacaacaaaaaaagcacaaaatggagatgtccctgtgttctaaaaggaaagaaggtactgccaagttgagttcaggtaccccaaggtcatcttgtcattggtgggaggaagtgggggaccctatccactgcacacaggttactcccaagagtgtgctgggggtgggggttgggatggcctctctgggcactccaggtgggacagaatgttttcggggagatttggctctggttttgactaagcttgatttaactttatcctaccttttcttgcagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtgagtgcgtgaaacccaaacactgaagccgcatgaaattagggtttcagccagcttagcatccctttatttttatctccttcaggttttatagctctttgtagatatccatatgtggatttccaggtctctcttggttagtgccagctgtatttacaacctggacctagaatcaaaacgtttgaacctgctatacagatcaccccttccagacccttcatctcacggttgcagaacttgaaacccagagaggccgggtggcaggccttgtggacaggcagttggtgggagagctggcctggatctcattctcccatcaggtctttttatagtgtagtgagtgattagtgggcaagtcagggagactctgaaggcagtttggcaccggctcctctatgtactcactgagtccttgcttggtacacaaggtcaccaagaggcttccctagagaaacatgtctacactcacaggaaggaatatggagaggcagggaagctagagtggcagaattaatcccatcttctccttaatgacaggcttacagatcaggggtggtttcactataattttaaaaatatttgagtaacaaaagtaatgtgagaacatcctagatagtttacaaaaggaaaaaaaaaaaccccaaacccaccatcccatttttaaaacattcttctgttttaaaattttccttcagttgttttctcatctgtatagtttgataacttttttcatatgtaagtaatgcatattcattattgaaaattggaaaacatagagcaaaagggtattaaatcacctaaaactgccatcattcagagatagccactgttattatatctggccaatagtcttctgggattttaatgtgtatattaattttttatgtttgcacacacaaacctatttaaacatatataacaaaaatggaatcattacatgtgccttatattctgcttttcttcacatacatattgtgacatttttctgtcaataattatatttgtaaaacactgcatagtattacctaagtatggctgtatcaaataatatctacctgctctctaatttttagacatttagatcgtcattactcatcactattttaaataatggagaacatcctggtaactatacctttgcccatattttaatttttttaaaagatagcattttaatataatttttatgtcaaaacacctacacaaagttttgtacatgttgtcaaaaataattgtggaaaggttgtaccaatgtctatgaattctcaattgtgaatgcttgattccttataccctcaccagtaaagagttagtttttaaaaatcttttgataccttgatggtataatgagtgatttcttattttaatttaatcttcatatcttgatttcttgagttgtagctttttctatattgattgaccatttgtattttatctcctgataaatgaccatttccagttgcatattttgaattctgggtattttcttgaccttgtcacagggattttctttcaggtttttttttttttttaaggaaacagggtttcactctgttacccaggctagagtacagtgcagtatagctcactgcagtctcaaactccagatccaaagcaatccacctgagtagctaagattacaggcacatgctaccataattgcttaatttttcaaagtttttgtaggaataagttctccccatgttgctcaggctggtctcgaattcctgggctcaagcagtcctcctcccttggcctcccaaattgctataattatgtgtgagtcatctcgcccagtttcacgaggatttgctacattgctatatggtacttaaacaatcaatgaaatgattgtacagtagtccgtcaaatgaatgtactgtaaagtactaaagtatttctttattaatacgcatttaagccaggcatggtggctcatgcctgtaatcccaacagttcgtgaagccatggcgaggggactgcttgagccctggagtttgagaccagcctgggcaacatagggagaaccccattcccacaaaagcaatttaaaaaattagctggacatggaggtgtgcacctgtagtcccagctgcttgggaggtcgaggctggaggattgcttgagcctgcgaggttgaggcagcagtgagccatgatcgcgccatgcactctagcttgggcaacaaaatgaaaccttgtctcaaattttttaaaaagggcttttagattatttagacttttttttgccatatgaataattcttgatatagtatccttatgtgtataatttcccccaacttaaaattattttataagaaaaatctttcctgaatctaccaaaaggcataaagggcctaattgttttaaaaattacagacaggtaggatactgatgtttttgtttttgatcagtatttgttagtttctagtcccttatattgcattcagtgcacatggcctatagaattcatatttggggaatgttttgaagacgtatgtcatcataaaacacagtattctatttttaataagtattttgagtctggaaaaatgtgtattctctattatttaggtgtgaaatttcgcatttatctaaattgaatttcttattattttggtctctttgctcaattgattctgacagaggtatgtgaaaatattcctgttatgattgtgattggacattttctccttaagtcctaacatgtttgcattatatattttaaagttactctgcttagcacgtaatgattaaggacatctgcttggtgtattctttttgtcagtttcacatatcccttttcctgtgaattatttaaactttgaattctattttatatgattatatttccactgtttctttctctttgtcagagtttgcttggtggagctctgtttaaccccttctttttaaccttcttatgtaaatgttttgtctttttaagctgagtttggttagatttttttactcaatctgaaaatcttttttgcggtaaaatactatctgtgatattgttctagatatcttgtattgtatgttttgtcaattatgctttttcctttttcatgtctatgactggatggtttttccctgtatttgcttgtaattatttcagaagtatataccctattgcttttcctccactgagtatctttcatttagaataaaagttacttaaatcatcctacaaagtagagaaggaaaaaaagaaaaaaagttatttatttcttatggcacacttatggcatacacaggactttgaagaataacggaatgaatgccagggatccatgtgctgtataagaatgaacatcaccagtgctagttaatttcccagatgttccttccaaattgtctcttgctccagcatcaatgtctgcagtttggcattgctattcctttgcctttattatagcatgtctacatttctaaatataggaaggcctcacttaatgtcagtaggttcttggaaactgcgactttgagtgaaacgatgtacaggatattctcaaataacatcattttgctcgacatcattttgtgatagctatgagggaaaaaaaggtgttttatgttcttttgcttaaagttgcaattgcctacaacctgagggcattgttgagcaaggacttactgtagtagtatgtggtattgttttgcatgtttttatactgtctgtacttggtctgcatatgctgtatatagttttctgaagtttgacttttcactcaacatggtaacatttgtatttgtcatccatttcgtttaagaaacatgtatatagttactacatgccaggtactgttctaaaaacttgataaatgttagcaaatattagttctgtgtatagtagtattattatttctactttacaaatggagaaagtatgacagagagattaagtaattgtctaaggcatagagagattagtaactgttgatactgatagctctgattccttcatttttcactactgtgttgtattccatttcacaaatataacatagttttaaaaattactcatccttccctctttctttctttttttcttttgttggttgtgttttgttgtcatgaataaagctgttaagtgggctgtatatgtcttgtagtatattgtgtttctacttaggagtagagtttatgagctagagagtatatagatttgagctttactaaattctggaaaattcttttctaaagtgtttgcgtggacatattggcctgcttgcaagatatgagttctcattacggcacagactccccgacggttggtattgatgtgatattcgctggtattcttctttgttgatcccacagtgccacttctgagaatttattctgtggatttaatagcatacacacacactgatacccaaggttattttattttattttattgagacagggcctcactctgttgcccaagctagagtacagtggggcgatctcagctcactgtaacctctgcctcctgggttcaagcaattttcctgcctcagcctcccaagtagctgggattacagacacccaccaccacaaccagataatgtttgtattattattattagtagtagtagtagagatggtatttcaccatgttggccaggctggtcttgaactcctgacctcaagtgatctgcccgcctctgcctcccaaaatgttgggattacaggcaagccaccatgcctggaccccaaggttatttttttgaagcgtttttcataatagtaaatattagaagaaacccaaatatctttaattagtttcttggaaactgtgactttccaagaacctaattcttggaatgggggccagctaaataatttttgctctatccgtatgattaagttagtttgtaaccattaaaggaaatgtggaaggttcctatgtactgataaaaattgctaaaatatattgttaggttagaaaaagcaagacacaatatggtgaatatagtataataccttttggcttaacaaaggagggagaataataacacgtttgcccaaaagtgataacctagagtggtgttggtaatggggtggataggacacaaggatgaaagtgggatttcttctcctgctccagcaccactggatgcagtttagcattgttgttcctttgcttttatttgtagcattttatgcaccttttggtattgtttcatttatataaccatgtggatttattaactggtcttaactttgagccaaactgattggtatgaattggatctcgatgtggtttttgcattgacctgattgactagtgaggttaagcttgtgtttcttggctgttcatgttgactcttctgtgaattatctactcacatttttgctcttttttctataagattatttgttgttttcttgttgtagttctttatataatgtagccaataatttgttataatttatagctcttgcagatatcttgtctcaggagattctgatacactgttccaagtttcttcagaagttttgagttgtcaatctttcttaccatgttttgtcttttagcatactgtttttttttttaattttttaatcctggtctgtttgctaaactttgtcccaatttgacgctgtataaatcccacaattatatttttaccagttatgattattatggctttataatcttgatacttaaaagtcagttctttgacataattcatcaggatatcttgaatttatggattatttgggctagaatggacacttccatgacactgaatcttcctcttaattacacttaaatttaacaaccataaagttaattattataaagtatctgactcatgtaatcagactaatttgttctcatactaaagctaacttttgcagtgaatttttagccttgaaagaaaggaaaatccaagtttagtaaagaaaattggatactctttttgttaatatgacacatccttgggcaaggaagaaaatgagactgaaccacatcttgtggaataacgtctccttggaaatacaggttcttctgtttttgatgagatttccttctagaattagcgcataaacatgactcatatatagtcacttaagtcctacgttgcacagcctgcaaaacatgagttactcagcatttcttttcagaagcaacacacagcaaaacaaaactaacagcaaaacaaaactaacaaggaacaaactgttttgaagcagaaaaggtaaaaacctaggggattttctgattttgcaaatatcaccgaaatgggaggaagatgatgtatcctgatttgtcactaacttagcaagagaacacaagttgtcttatttcagaaaatttttgactaataatccatggagagagagatatccaaatccattccttttgcttttgaccccatggctgagaaaacgtttactttttcctctcttgtttgacaacttatcttatttcttctcacaaatcctttgaggtcggtgggtcaggaagtgtcatttgatggaaaagaaacaattgtcgatggtggaaataacagcagacgtagaatacaaaacttagattctagaaccaattctgctattttctttggccttgggcaggctaattattactattatctgtatcatcttaccaccatcgctatttataagacacttgcttatggtagtctaagtctctaagctcagatttctttttttacctaacccttgaaattgtctttatttaaataaagtaatttgtattcattgctaggttaaagttttaatctaactctcttggaataaaatataaaatacaacccaaaccagtcagtttattaaagctcatttatttcagttctccacagctatattttatgtatcatgcattattttgttttattcacatatatgtcattttatcctgttcataacctcctccttctccctgttcatcataaattccttgaaataaattttagcactgaaatgtttaagaagattgtctgtatagatatctctcagtttctgacaactcttaccctacagtgctcagatgaatgattggtccttggagggctgagtgacacttttggattgcatcttagatggctagtagcctgcagtgataaatatatttactggaagattctaacttggttaacaaagatcagctgtcctgggagtgtgaaatcttcaaggccaaaaactcttactcatttctgctcttgcagctgagagtaatgcctggcgtatagtaagtactcagtaaaagcttgttgaatgagtgaaagagttaccaaaagattccccttgccaggacagcaccaagggatgtgggcactccaggaaggtcaattaatttagtggagcacaaagaaaatcggtttccttattcattttaaaaaatggcaaagtgattaactgactaatccactttcattaactaaggcagagtgcatgtaaagaaaattcaggagaaaaacattttccattcctctgaacttctcatattctctctgaattttgtcaggtggttttccaaaccagacaaaatcctgagaggcatactgaggtgtttgaaaattagcgacatatgttgcatcattgtgcgcattatgtattgtcagagttttgactacaactctgtgagcttgttgcaaaaatggcagcagtcaatgctaagattgttttcccttttcttttttcattgtgatttaaaaaatgcataacgtaaagtttgccatcttagtcatttttaaggtatagtttaggagtgttaagtagattgacattcttgtactataatagatctctggaacttttcaactccagaactgatactctatacccattaaacaactccccattcccacctaccacagcccctggcaaccatcattctactttttgtttctatgaatttgactactttagatacctcatataagtggaatcatacagtattttctttttgtgacaggcttatgtcatttaatgtcctcaaggttcatctgtgttatagcatgtaacaggatttccttcctttttagggctgaataatatttcattgtaatgatataccacattttgcttatccattcatcacttgatggacatctgggttgcttccacctcttggctgtgaataatgctctgcggatatggttgtgcaagtatctcttggagattctgctttcaagtcctttgggcatacatccagaagtgagattgctggatcatgtaggaattctatttttaaattcctgaagagcctccatgctgttgtccatagtggttacataattttatatccccatccacagtgcactagggtttcaatttatctgagtgctcaccagtactagttttattatgttttcattctttcattttgtaatagtggccatcctaacaattgtgagttagcatctcattgtggttttgattttgatttccctaagatacgcaatttactaatagcttctcacattctgtaggttgctttttcacttttgattgtgtcctttgatgtataaaagtttttaagtttgatatggttccatttgtctagtattttcttttgttgtctctgcttttgctgtcatacataataaatcagtgccaactccaatgtcataaagcttgtcccttatgttcttttctaggagtttaatacttttgggtcttatgtttaggtctttagtccattttgagttaatttttttatatagtacaagatatgacccatcgttattttattttacttttgcatgtgggtatctagttttcccagtaccatctgttgaagagactaatcttaccccattgagtagtcttggcacccatgctatggatcatatgaccatatacatgagggtttacttctgggttctctattccattggcctatttgtctgtctttattccagtaccacactgtttgattgctgcaaaatagatatggctttgtactatattttgaaattatgaagtgtaagtcctctttgttctttttcaaaatcgttttttgctatttggggtccctggagaatccatgtaaattttaggatgaatttttctacttctgcacaaaatgcccttgagattttgatagggattgccttgtggttgctttgtgtaggatggacatcttcacaatattaagtcttccagtgcatgaacacaggtatcttaccatttacttgtgtctttaattcctttcagtggtgttttatattttcaaggtaggattgttattttaatttccacttgagagtgctgtctactttgatgaaagcaggacaaatatccatgcttctagcttggtaagaggttgtatcttcccgtgttaactgacaccctaaatctgcttttctcaaatgcattctagcttcttagagttccccgagcaagtactcatcagaatgccttataacttaagctgtgacccatggagctttttcccctagacccagtgctctggggaaggcagaaatcctcataactggtattgtgttcatagaggggaggcctccacatctgatgcaagcctggccattggtgactgggcgcaggttgttgagctctttgtcctggcacatgccaagccatcaaaatctacatacctctactctgcagagtgagagctctggtgctcttagagggcaggaggtggtcttcttgctcctttgtgaatcaagagggccctgagttggggccaaggagagtgggcctctgggtgttgattttctctgtttggtctcattccagctatggtgcacacagggccttgatgccagtgaacctaggtgtttatttagccttagaagaccataaaagggcctagcaggagcttatctcttgctcttcaaagaggctgtctgaaataagcatgttgacaaatcttgcatgttactgttatttaatcatgaaactttgcagttccttagtgttgttacaaggaagaatgtaggtaattcccaacttgctgaaaacctactcatttccttttaaaaactgttattttaggaaaatgttgttggtctggtgcaatgactacatgtctcttgaacctcaaacaaacaggtgtggtccacgtcatagtcttctagctggctgacttcatggaggttcagacaccagattggcaagggggagggagtgccgtgttttatggcagtcttcccagctaaagctctctgagtccaagttggttgagccttctgttcttggcagattttcctttagagtgtcagtgccacaggccatgttaaactctttggtaatcttctttcctaaaatgtctggtagaaccctgaaattagactttgggcctgtgaacatctcttctgtggcccttttattccctgctctatgtagttttctattctgctaacaaagacagtggaggtcagcaagggaggcatcatcacagaagactttataagaggcttggatttcagttgtgggttttcaacccctacaaacccatcttccagagtgataaaggtgggtggagatggacacagggcctgcagataaagtatttccccttgatgtgggtttctgtgtccccacccaaatctcatcttagatcgtagctcccataatcccaacatgtcatgggagggacccggtgggaggtaattggatcatgggagctggtctttcccatggtgttctcatgatagtgaataagtctcacaagatctaatgctttataaagggcagttcccctacacacgctgtcttgcctgctaccacgtaagacgtgcctctgctcctccttcaccttttgccatgcttatgaggcctcccagccatgtggaactgtgagtccattaaaccttttcctttataaattacccagtctcaagtgtttctttataaccgtatgaaaatggactagtacacccctgttgttagacgtacttgaggactcccttgagatgacgaggaagatgtttgacatccaggaagtaaagaggtgcctgacatatcccaggacacttccatgtgggtgatcttcacattgcgaaaagactgatggactgaagtgaaagcaaaatgtgttgagcaacagtagcctcaactgctatcactgttgctaccactaacatttgttttggatttagtggtttataaagtgctttgccatgggtgttgccggatttgatccatctgtcaaccccatgagatattgttgctgcagtatcacttctagagattagcaaaccacagtgcaccgtgtagtttggcttccccagggtcatgaagttgctcagtcagagccaggtcctaaactgctgatttctggttcttaattgcaagatccttccaaggcacccttccactgtggtagtcactctcaggaatgcgtagaaagagtacatcgatccttaccacttatcaactcaacacataagaaacaaaaatcaagctgttacattgcgcggtaatctgtggcacattaggaaatctgcatgggctgaaaggtcaaggaagaagcttcccgaaggaggtggaacttcgattggcccttgaagaacggatgggatttgggaaggtggagggcaggagtgtccggggaggcatcagcttgtgtgatgtgtcagggtcaggaatgcacactgggcgtgtcagagccacagagttaacctgctggcttaaccagtgtgcttatgttttaggaaaactgtctcctggtgtcattctgtctttcaagcaaatcctggcagctcagattttctcagccagggtgcaaaatggcagtttgtctctttttgatgaaaggaaggcttcattgtcactggtcttgcacaaagagcccttggagagaggggacagtgcacggggacagaacactaagggtagcttgcgttccttcagaatgattacatagaatcagcggcacttccttcctctgaagtggctttgagtttcctcgaaatagcctcctctgtaacatggttaagggaacttaaggatgtacctgtaagcgtggtgaagtggaatttctgggggcagttcgcagggcattactagatggcctaaaaatctctttgtattttctggtgacaggtctgtgactcttatcctactgaactgtacgttcccaaatcggccacggcacacatcatagtggggagttccaaattccggagtagacggcgatttcctgtcctttcttactattataaagataaccacgtaagtctcgaggcgtgtttttgttttacactttgcttttctagtttatcataagcaggcattttctagctgccttctgctgtgcgtgtgtgtgtgtttgaattcttcagaaggtatgtggatattcctgtgcatggtatgacatgatacaactatgctaagtccttatctcatgtagacttcctatgtttatttgacagtaatgtaatgattcagaaaatgactcaatagattcagaaaacccctaaagctaatcatgcaagtgaatactgtcctaagtgggcaccttgggaatctctttgcttattcagtgctggagatctgtggcatgcctattttagaaaagcccccgaagtccatggcccattctttttctctattacgtttttttttttttttttttgagacagagtctcactctgtcacctgggctagagtgcagtggtgcaatctcggctcactgcaacctctgcctcccaggttcaagcaattctcctgcctcagcctcttttgtagctgggattacaggcacctgccaacatgcccagctaattttgggttttttttttgtatttttagtaaagaaggggtttcaccatgttggccagggtggtcttgaactcccgaccacaggtgacccacctgcctcggcctcacaaagtgctgggattacaggcgtgagccactgtgcccggccttattacctgtttttaaatttcatgttcttttgagtatcttcagtataagaaatctttggttatagagagcatgggttttatttttaaaatattatttataaaagccagaattgggtttgtctgtaatagagactctaagtaacagtggctctaagaggatacaatttttttctgttgcgtaaaattaccagggtgcgcagtcctagcctggtagcctggccccaccccacttagccttcaggtactcaagctccttctacctttctgctctaccaccacctggatttggccatggcctgcctggtgcaagaggtcacttcagtacagtcaccacccacacactgcaggtggcaggtgacggagggctaatgttgtgtgcccagctttttaaggaaggcttccaaaaactgccacgtgacacctccctttcatcagaattgcacagggcaggtgtggaagtacagtgttatgggtggccattaaaatagctaaaacttagagttccatttctgcggaggataggaaaacaaattcggatgagcaagaatggtctttggcacccacttttaaaaggtagcaaaaaaccacctttaaaaaaggtggtttaaaaaaacaaaatgttctttggttctagcaaggtgagagagaaactttagtttttaagctagataatatacttctggattcaaagccgagtgaggctataaacacaggagattgtgtgagtgtgtatccacatgcctgcacctacagccggggggtagagcagggtctcagtcagattctagaagcttccaaaaatatctggagcaatgccagcttcatcagagtgagcacatagccctctctgttgctactttgaaggaaaatattaatttggtggtgaaagttctgtgaattggataaaaattatttttagttatactcattgctcttcttcttttcctagccttgaattagggtctaaagtattttattaactctgaatgtatttcagcttgcacagagctggagcactggttagaggcaaaggaagatgtgatttttttttttttttttcggaaacaagatctcacttgtcgcccaggctggagtgcagtggcacaatcttggctcactgcagccttgacctccccagactcaagtgatcttcccatctcagcctcccgagtcactgggaccacgcgtgtgccacccggcccagctaattgttttgcattttttgtagagacgaggaaagccatgttgcccaggctggtcttgagctcctgtgctcaagtgatctgcctgcctcggcctcccaaagtgctgggattacaggtgtgaggcgccgccccttgcctcttttttttttttttttttttttttttattaagataggataaatagagataggaagtttcatgatgttgcacttgaaattaggttgctggtaacatgcacatttttttttttgtagcatccattgattaaagaagagagaagatgaatccaggagagggagaaacgatcttttattgttgtttcagaggtgttttattgttgtctgtagaatatttaaaaagtgagcacagtgtgcctagcaactccctttttatattcttgagacaagggacattttactttttgtcaatgtgagtagtatcaggattaaatatgtattgtctcagaaagagaatttttagcagttagacctcagaggcagcttcttccccggctgacctcagacccacatggctccacgcctgctcccccaagtgctattttactgaacctccaggcctgaaaatgaactcacacagcatagttagagcttaagagtattcattgcccatatttaagattttaaagcagaaacaacctgaagctctagctcttcttccaaggtacagaacagagatgtgtctcgaagcagcgctgcgtgatcgggttaccccagggaagtcccgagtgagcacacacctgcccgcccactctcccaccccatgaactgaaatctattttgcaggtggaataatgatcaaatttgtgttttataacaatgtttacattttaatatcaaggttaattatataaatgcttctgatttgactagggcttttcctaaagggaagtattattaccaaaggtggatttctgtgcttaatggaagacactgaaataccagagtagttatctgtgctgtcattgctcatcgatggccgtatagaaaacaggcagtctcccacaaaaagtaaacaggtacacattccataaatttgctgatctgtctttcttctctttggttatttgagacattttaggcttaaagagtatgtattcctacccccaaagaatttatgcttatgaataaggatactacattttatagtgaaaatactgtttcccacgtatgctaccaaagggacacttttgattttggtggtgagatgacttggctaattttgggcactgggaactggtgatcagattaggagaagcttgaagtgcacgagattttatgaacctgaagttctgttcaatataaaggcccctgtggagggtccatctttccctttgtatcagctgttaccacatgtagtgttaggttggtgcaaaagtaatttcagtttttgccattacttttaatggatgtaatcacattctttcacccctgtggtgagggagggattcctgctctaggttacagggacagccagacacacagcacttgacactgggcaggtgagatgaacagtcacatatactcactgccaaggggaggaggacaccacagcccatgaaggggcacatgaggttgcgctgaggagcagagtgacagccaggggctgtgagaggcaggctgtgtagtatcaggagcgtggggtcacccttggttcccacaggaggatgtgattagcttgcgtgcatcattccatgactggcagggaactaaaacctgcttctgggggacgggcaggaactgcacctggtctgttggataagaattgtttcacttgggaaccttacctgcaggagcagagcgtggcagggaacttgcagtgaggccatttgaggccctctcggttttaccagatgtcgaagcaacacataatattaattttaggccttacgcacatgggttatgtagagccacgtgggctccctttgaatatccagctattaacagctttatagatcatggttagagatgcttagtcatgtgcgttcggaattctgtgcatctttctttgagagttcttagaattgctatagcctttgttctttattacgctaggattttttttttaaagtttcactttaagatggtgcacagcatggtctcccaaatttacagtacacatttcgaggaaacaaaactctagaagatttccagtgaggcaactttccttaggaaaaatacagaccttcatggtctcttttcataatgaatacttattgaaacttcctatgtgttaggcacagtgccaggagttttacagtgttatgccccttctcacactctgtagttttaatattttacccattttatagatgagaaaactgaggatcagagaagatacataaattacccaacatcatacagtgagtgagagcacaactggtactggaagccaggtctttctgctgcatctttatgttttgagatggagtctcgctctgtcacccaggctggagtgcagtggcatgatctcagctcactgcagcctctacctcccatgttcaagcgattctcctgcctcagcctcccaagcagctgggattacaggcgtgcaccaccactcctggctaatttttgtatttttggtagagacaggtttcaccatgttggccaggctggtctcgaactgctgacctcaggtgatgcacctgccttggcctcccgaagtgctgggattacaggcatgagccactgtgcctggctttatgctgtatcttaataaggtattgtgctgcctgacctatttcctcccattggggcttgaattactttgttaagaattcaggatcaggaaatactctgtctggattcaaatcttggcttccctatttactaactgtgtgactttgagtatgttacttaacctctctgtgctttggtcacttcatgtatcaagtggagccaataataggtcttattgtatatgataattaggctaattaaataaaaatatgcaaagttcttataatagtgcctatcatataaacactcaaaaacagtagtaagccatcaaaaatgttgaatattttaattattagtagcattgtaaatgagcgctatcccttccggtttacaactgaagagtttttaatctgtgctctgacatcagtaagaaatgctgccaagtaatagtaatactctttggataatctgtctagggcatgtataggtgcacaaaagcactgagactacttactgttctgcacacaattgaaaaccacatgttagcaattactgattcaatgaaaaattccatttagatcatatctttagtttattaagaaaatctaactacaaaataccaaaaatgtagtctgtttaatatgcgtgttttaatttatcgaccacattccacagtatataacagttccagtatagttcctcatttaaaactagctgttctaaaccagaagataatttgaaatagttgttgtccctaaattgcttcattttgtagttggtgtctcactgctttagtgaggtctggtgtgtgtgttctcaaattctcgtcatttaaatgtgttaccatccccatctaacccttctgatggaatctaagattgtctggtggcagctgtccttaactaatatttcttttttttttcgagatggagtttcactgtcgcccgggctggagtgcagtggtgtaatctcagtgcactgcaaactctgcctgtcgggttcaagtgattctcctgcctcagccccctgggtatctgggattgcatgtgtgtaccaccatgcccacctaatgtttgttgtatttttagtagtgatggggtttcaccatgttggacaggctggtctcgaactcctgacctcaagttatccccccgcctcggcctcccaaagtgctgggattacaggcgtgagccaccacactgggctaactaatatttctttaacccggataaagtatcatctaaagccaactcagaattattctctttccaggaagaattccctctgagcaggtggcagaccctgaccccttaaagattaaaggaaacaggacccctgtgaaagccatctgtgtcatttgatttctggtcttcggacatagcttgccttctgcttgccaagtccctcttgatccccatcttcacttccccttgctcctggccttgccgtcgcttgccattctgtctgccgtgcccataccctttgatctttttctcctccccaccagtcaggaatgagccaccctggagtgactctgctgctgcccctttgctttgcttcccacgcccacaccttgtccccctggattctcaatctggctgtaggcctcaggcttcctttaaccccctcagtgattgtccgtctctgcagaatggtgttggcgccctcagacaatggcccctgtaatatgtccagccattctgtggttctccaacttcagagctagtgagaaatgtccccaccttctccaacaaggagcacccaagccctttggagagatccaaacccatgttcagttgtcctgggttgggattcaaagacaattaagctatggttggactaagagttggggtgccccttcatggatggaaccctgcaatacaagcacgctgaacaggctgtgacatgacaggactatttgcagtgaaactttcccctccatattatcctgcatggaggggttctgtcactgcctgcattctttcacactgtggacttacagtctcaatgtagatgctttgagtcattcaggcattttattgggtgttttgtgtttaagtgttaaaacctaaatccatgaaagtactttgccacaaaagccgaagttttatagctgcaaggtaggatctgtactacctactcataactcagggaaatgtttctgctcttctagatgtcatctgacagtgcaatctactctgtcagaattgcagggtacgggacttggggcagagaatgcagattgattccaaaaaaaaatcccccttgttctaagtagacttgagtcagcacaggtatgtgcctgctgtccttcggtttcaaacctagcagcaacctgggctcttgtcaccgtgaaagtttcccgtttagaattagaattggtttttggtatttgtgatgtttctagatgggctagtttaaaaaaaaaaaaggttggaaagcattaaaaaataatttctattttattaatgtcaccattaatcgtatcctatgcatttgagaacggttatttattttgtattttttctttcagcaggaaaatgaagcaatatcagtgaaaaggaaagtagattatttaaatggttttgaatatcataacttagaccctatctaaacatctctacacattcctaatattttgcacagacaggttctttgtattgcttgcccattagtggtttgacttgaattttaataaacaaggcttgatttccagaaagctgtatcacgttttcataagccgaggtggactatcagtgagccaagggctctttgttctggagacacacgtagagtgtctctcatgggtacagttacctgatggtgctgtgttgctgtgacctctccccctaggcctccatctgccggagcagccagcccctgtccggcttcagtgcccggtgcctagaggacgagcagatgctccaggccattaggaaagccaatccaggaagtgacttcgtttatgtcgttgacacccggcctaaagtaagtgtcaccgttgcgatgcatgtctttgcacctgagttgtgaaactggagacaggcaaaggctagccgactgccatctcttgtgcaggttgcttcatctgcaaaggggcggttcctcttggcatagtcagtgtctgggcaccctgctggctacttcctggaggtctagtgcacctgaagcctccaactatacaagtacatttcatatttcccctgcccctagcattgtgctgggcacacaggggcacccaaatgaatgtggcttcattttggagattgtgctcctaagtataccgtattagtacttggtttctttctaaaacagccctttctgctctgacaataaaattcactctggagctccagcagttcaattgttgcgaagtactcagctattatttttcaaattcaacttgtagtaatctatacctatgacttggaaagaactataaaatataaggtaaattaaaaaatatttttttcataaaaagttctaggtgtgtaaaaaggtgtagaaaaagatctgaaaggttaaaccctgaactctaaaaattccatggagaagggagtaggatttgcggacgtagagggctttctacttgttgattgttagaaaagtattagtttacaattatgtatgtattaatttattagttttctaatttaagaaaacgaataggaaataatatatctagacatcaaggagtgagccacattgatcttacacttacctcccactcagccttaacttttttgtttttaaggagaatcagtgttaagtccaataaaattccagtttttctccttagacccaagtcttctaaaacttcaacaagtgaagtccccagagggatggacacaaagtcacctacaagtgcattgactacagcagacagaatgagatgacagaatgaaacgtcccttagtcagcttatttgcaattgcactttcctagccactaatgaaaatgtgcctggacctgtgactgaggagaaagatgaacgtccagttctgtctccttgtatggtaagcagaggagtccaggatgtcctgttaggcaacaagagtgggatagagaaattatgtttaatcttgttaaaagaattggggctgggcgcagtggcttgtgcctgtaatcccagcactttgggaggcgaaggcaggtggatcatctgaggtcgggagtttgagacaagcctgaccaacatggtgaaacctcatctctattaaaaataacaaaaattagctgggcatcatggtgcatgcctgtaatcccagttactggggaggctgaggcgggagaatcgcttgaacacgggaggcggaggttgcggtgagccgagatcgtgccattgcactccagcctgggcaacaagagcgaaactccatctcaaaaacaaaaaacaaaaaattgagagaatgtataccacactgtttacagtggtttttcctgtggggtgagaagttcattttaggaaacttttcacttcgtaagttagagtttgaaattttttttcactatagaaaaggtaaaagagcataaggactttaaatttagttaaaaatagagttaccatatgaatcagctgttccttcctaggtatataaccaagagaaatgaaaacttatgtccacataaaaacttgtatgtgaatatttgttcattattagtaatagcctaaaatgtaaataaccaaatgttcataaatggagaatggatttacaaaatatggtatgtccattcagtggaatattattcagctataaaaaggaatggactatggatacatactgcaacatggaggaaccttgaaagtgtcatactaagaggaagaagtctgtcacaaaggaatcatgaaatgctttcaacaggcaatttcagagctattgaaagtaaactgatggttgccgagggctgggggaagggagagaaatggtgagtgaccgctaatgggtagtggatgtctctttagggtgatggaaatattctaaaatgagatcatggtgatggttgcacaactctgtgggtataccaaacaccattgagtcgtatgctttaaatgggtgaatagtatgacatgtgaattacatgtcagtgaaggtattaaaaaaagaacataggaaataaacattacaacaggaagggtaaaatagaaccagcagctcaagtcatttaaaagtgtacactgtggggaagaggtaattatagacacggtctacactcattggtgatcccagaaatcacgagaactgcatcctatcctttgtgtggatactcaggccttggtgattttcacggattctctgaacttcatgtcaccaagtattatgatttgtgtccaggataatggaatgtgatgttttcctagagtgagatcagtgccctactcgtcccctcatctcagaaccatccagtcttcttcggagcaaagcacacagcgggagagaagtgtgtggagttactactcacggatgccagatgagcgaatcagtcctggagatcagtgatgaaaccgataccacagctagatcacattcacattctactagattataagtaaagggtcccttccttttaaattctcagagcacgacacacagataaaagtttcaaactgaaaaaaaaaaaaatagctcctttgctggaagattttcactgaaacataccagaaaatctctggcttttactgttctctgtcaatttgtgcccttctctctggctcattgtgtttaaacccttccttctaatgtgactgccttcccacctcttcttcgtaccctttgttgaagcaaggtggggctgttttgaatttcctaatagttacagatgatttaatgattagctgcttagatatactgaagacaagataagaaaaggaagagaaaagacgggggctttactgaggagagattgggaagcctgtttcttaccctgtttttttcagatttaaataaagccagacagattcacctactaattttaggaccagtgatccagatatgtactgtgttgtgtaaaccttctaggaaacgtggcagctgtagagccaggcatattccagatttaaaataagttaatccaaaggatttgatttgaagggtatatttagtgctaagtgtgtttactctcagcgatgagtttgacactgatccattaaagaaaactggggtttcgtacaagccatgccctcttctcatatttatccatgcacgcacacttcacgtgagttttaaactgtttacttagagctttcattcttttaaagactgtgtatgttgatttttgttccagagtgtgttaggcctccttggtagccaggagactgagtttgctctagaaggtgtggaccctggcaagcaggcacttctcaggtttgctcacaggtttcattaaaaagaaaaaggattaggagctgacctgaatcgttcctggcctttgagcaaggctagccccacatgagaacttccagagctgcctgttcagatgaaagcctcagaattacttgttgacattttttgggagacaccagcctgggcaacgtagtgagacccccatctctacaaaaaacagaaaaaaatgagctggatgtggtggcatgggcctgtagtcccagctatttgggaggctgaggtgggaggattgcttaagcccaggagtttgaggctgcactgacctgtgattgtgccactgcactgcagcttgggcaacagagtgagaccctgtctcgaaagaaaaagaaaaaattgggagacaaagtcaatgaagtcttcaagcatgtattgaatgtcaattccaaaaaaaaattatactcttcagggcacgtattagtgctagggtgtggcgctttaagaacatatgaaggtgttgtcgcagtcttcgctgaattttcaaatgagggctaactcactgcagccttgttcatgactttgtcattaatttgttctgggactttgctgagcttgtaaaaatggcaggcactttttttttttttttttttgggacggagttttactcgcccccaggctggagctcagtggcacgatctcggatcactgcaacctccatctcccgggttcaagtgattctcctgcctcagcctcccgagtagctgggtttacaggtgcccgccaccacgcccggctaatttttttgtatttttagtagagacggggtttcaccaggctggtctcgaactcctgacctcaggtgatccgcccttctcggcctcccaaagtgctaggattacaggcgtgagccacggtgcccagccaaggtactttctcatttagttcttttaagaatcctggcaagttaggagggttttgttttgttttgtttcttttcatggataagggctagaacttaaagaggttaagtaatttgcccagggtctcacagtttacattccaggattcacatccaggcttatctaaccccagagcccacactcgctccgtttgaccatggtgttttttctgtttacaaaaattctccagcagagcctcgtttccacgtggaagctctgtggggttaccacctctgagcacacgcctgacgaggccagagaacctcccagcagctcctctgacgcagccagggccagcggagggggtgctgaggcatgaagagaagggccgagggcgaggcagcgcttgcctccgtgacgcctggccttttgtccttgctccttctccagagactttgctgtggttctgccccgtgatttcaccaggtcagcgaggttttagttgtgtaacaggatgtcacgtgggatgtttttctttttctctggaattagtgagtaggtggttcctactcgctgagtcctgggaggggtcacctaggaaagtcagtggtagagatgaggggtgcttgagagaggggaatcgggggtctcacacttgctggtggccgtcatggcagcaaccagagtgaagagaactggggcgagggcagtgtccagtggccgtggagcaatctgtgctccctccttttggcagggcaaggatggagaaatttcctgtgggtccagtggagcctgaggaaggaagttgagcatgagccatcttgcttcagcattcctaaaagggctcagccgccgggtgtcttcagctgtaggtgactggggtgggtgtgctggtgagggaagttgagcgtactggaatagactcaagccaaggcgcatctcctttttcagtgagatgtgtactccctacctccaaaaacctgcatctataccttgggagattgagcacttggacgctatgccagagagggaagtggtgaccaactcatgtcaaccgatgaagagagaattggaaccctgccgagctttccaaagagaaatttacctcttctcttctccctcctctgcacccatcctcccagtacacagatagggcctacaataaagaggagagggagggtgggccggagcaaacccctcagcagtccacacagcctgtaaggcggcggggaagagctaattttgcgtcacatacgggactggaattctaagttaggccggatggagattttctatctgaatgtaagtaaacctgatgctattaaatctgcccaagaggtccttagcgggtagaaaggaggattttgactagcacagttgtagagaatagttgcaaggaataaaatcaactcacatgtttgtgtctgcaccacaagtgaagtttcttcctgtaaccagttatataggagggagagagaaagaccgtcatttgaccacctgtgttagggcaagaccaagtccccctcctgccaagatcagcttgtacggtcatttcccaaccatgtcagcgtaggcactgtcattcttcaggcattaaatgtagctgtggaaatggtagacttgaggactaaggcagtgaccaggctgacctttaacctgataccaagatgaacacagactgagtttttctacatttgattgattcagggttagggtgagaatctcatgctgtttcttcacagtcttggcctgctctccccgggcctcattctgttatccagtcatttatgcagttgctcagccggtcagtaaatcttccttgagtgcctgttccatgccggtttgaaggatacggatgtggccatcaatgagacactcagggcccctcgtggagcctgcgttctccgtccctcctctctgtcagcgctgaggttttccgtgcccatccctctctgctcgctccttattcctgtgcatcttctctgttgtggacactaaatcagtctccagtttttcagttagacttgctcaaaatcctggagttgctctccgctgccacaggtggagcctcagttccttggctgggcctgttgtagtggaccctcagtgctttctagccttccctcttgctgtagctgccacacaggaaccttcgtcttcacctggagtggttcgctcattggttatgtagaatgccctcccctctctctccatccttacagattgtgttaaagtccagctctagctttctctcttaaacaaaacgttacccctgatccccaggccgacagagtttccttagatttcaactcctgtcattgtcactgtctctcccgttgctcagctcttgcccagtcctggtggatgtcatctgggaccactgggtgccatgtgctttcctttccattgtcagttctaagctgaaggcaacaggaacagcttcttttgattccacttaacgcctggccatagtaggtgtctatacagtgttgactttgcttcatttattaacttctctgcacccaaagacactgatattatcaaacagcaaatgaaccttgtgttaggaaacagggtatttttgcagtcctacttttcacctatctgttgtgtgtttcttaaacatgaattggaactgaagtgactacctttattgctttatctacttgagaacttttaggacctgaaatgcatagcttttctttagttgtgaaatggagttctcagtcaaagggacagaggaccgtatttgatgtagtaatagcgatttgtttatgtaagggatgccgtatcttactgcgcacacatacacgtaaaatgtccaagataacattgaatttttattaattgtaaaaccgtatctcctgctttgagggttcagcttttgctacattatcaggataggtcctgtaaaaaaggtggagatcctaagaaattacacttcagctggtagatgaaatattgccaccttctgttcattctgagaagtgcacattgatgttcaggaggttatttgtgttgctgctttgcttttaagggagattaccaatcagttctcccagatcaaggataatcagctatttcataatgtgtacatggagtcttaattataggttaaaataatattttaatttttgtttatgtttaaaaaatctattctacattctaacttttgtagactgtgtagtctgtctctctttttttttgtatctctgcctgggataaccctcctgtcccttgtgggtgaaggaggagaatgatcagtaacatggggtcttgctctgtcacctaggctggagtacagtggcacgatcacagctcactgcagcgttgacctcccaggctcaagcagtcctcccacctctgcctcccaagtaggtgggactagtcacatgccaccatgtctggctaatttttgcatttttttgtagaaatggggatttgccatgttgcgcaggctgatcttgaactcctgagctcaagagatctccccacctctgcctcccagaatgctggaattacaggcatgagccactgtgcctggctggtttttctttcttatgctttttaaaagagtatctctgtggtatgtggtgaataggcttcacttgaattagtcaagatacagcataaacgtaaggttcatgtcacgtaaggatactttcaaatctcctattaattttatttatgatgcttgttataaaggataaaccaacatctttgaaaaataattatacaaagcagtgatattttattagttttggaagaacaatgtctataggtaattttacaaaagttttccctataaaatatttatacttcttaaagtgtgaacataagttgtcttaaaatgcattattttaatatttttttcttgattaaggccaaactctttattctcgtagcatgcctgggagaaagatgacacccttttgtggatgggaacagtgtcctgaggggctgatgtggcccagctgatgtcacataagccacgtcatggagcagggctgctattgaaatgtgaggtgtctgccagcctgggctcctatggcaatggcttatcctctgctgtttttttcacttctaatatactttatttctattatttcaattacaaacttcatatatgctctcggtatcaatgaaagattacaggggcatccaaagtagtactgatggcattctcctgtcgcctgccatgctgtctttctgctgtaattgctgccaaattggtaccgttttctatacatttttattctgcttgataaacacgcaaaaacttaaatacatatctataagttggttttataaaaatggatgattgtatgaatattattctgtagcttactcttttcacttgtcatgggccaatgccaagtctatgcacagagggtctctgacttaatggttcgacctatatgattttgtggctttttacaatggtgcaaaagcaatagacattcagaaagtgtacttctcttgtgatgctgggcagcagcagcggcagcagctcccagtttgccatgcacttttcacttacggcattttcaacttccaatgggctcatcatgatataaccccatcgtaagcctcagagcatctgtctgtctgctgtgtgatctgtgccctccttcttggtcactgctcgcaggtcagggcatgataaaccattgtgtatcctgtcattgtcctattgagatagtcatgggttttcagcttttttcaataaacattcttgggcatctatttttatgtgctggtacttttaattttgtcagacttttaggagatctgtgtcaaagaacatatgtgtctttaactttaaacttagctcttttagcttttaaaaagtactattgtgcactgtgcttttaaaagcagatatttttttctggtggtgagttctcagtgtaggttctctgcctgggttagccctcctgtccttggtgggtggaggaggagaatggtcagcgaatgctgttttctaggatgtgatgacctgcttaataaaatagcaagaatgtttacacattctagaaaccgatgcatttcccagctaaagtaggacttgtccccttcttgattttagccacgcaggctaggacagtgtttggatttaataaacttcttcagataccactgtgacttaacctagtttgcacttggagaccccaacttctcatatgcaaaattataataatgaaagtgatcaaaaagcccaatagatctctagatttaaataaggcggctggtggaaatgtctctggagacttggttgcattccctctcttcattttattcagtaattcctgctcaaggtttaactgggcatctgagggatcttgtgggcaaattagaatgatgcaaccattcctatttgataacgtgtttattggcaatctaatactagaagatataataatgtatagagccttattttgacagctgtttctgctgatattcttctgccaacctaccggttatgtgtggtattaaattggactacttggttccatcacagaattccacattcagtttggcatctctgacggggactgcaagtgacatctccagaagggtttatcagtagactgctttccagctaagaaaatgtgacccacactgacaaattcatgctgttgaatataagctcagcaggagtccctgaagctatgtagttcagtacaaggttgcagtgattcaaataagcgtattatgtttccgtacatcattctgaatgctttgattgggtatccatgaaatgttttggttgtttcatcattgtttcatcaatgtaattgatgactgttctgttttgctgaccactgcagcttaatgcaatggcaaatcgtgctgcagggaaaggctatgagaatgaagacaattattccaatatcaagtttcagtttatcgggatagagaacatccatgtcatgaggaacagtctgcagaaaatgctggaaggtaaaccatttccttatgcacagcattaaaatgcagttaagtattttgatgccaaaagggaataagatagtcttgattttaaaatgtttttacataggtgtgataatttgggaagaatatcatgttacagtggctttttaaacacttaagaacgtttctcttatttgtaagcatcactgtgatgtggttttgtcgcttggtggttagcagtcagggactctacaatggtactgaacatctaaggtcaaagtgcacagggatgtttttgtttcttcctcataatgttagtttgatccccattcaaggccatttaggaataaggcaatcctacatttaaagcaataaccaaccattcttgtatggagatcaggctcaaaaactgatccttgctgaatggccattcgaagggagaatatcggaggagctgaccctcatttctaaacagcagccaccacaatacacatgcatgtaacctcccgccacctccacacacactttgacatatatggcgaacatgacaagacacgtacccacagacttatatactcgtgtggacaggaaattaaagagatggattatgtaatagagaagagttattcatgtggccaaccagccatatgctgatgagcagaaattctgcatttcaagcaaaaccagcttagtccgctgcttctgctccttgtgatcacagtgaccccaagaggaatctgtcgctgtagtctaccacttccggctctgcgaactgggaaaagacagaggatgcagaaaccatggccttgtgccttggctgtccatgcactgtctgcgcttctggggaaagccctggagagctggagctgggagcccgggaagtgggctgtcttgatgggaaatgcaggctctggaatgaagagggacaaataaggtgctgaattattttttccaggaatccacgtttgctctcagttacttaagccgttcttcgtttaatcagaacaccctaacgttggggttggagaaatctgagtgtcacaaacaggcctaatttccattctgtttcctggactttctggttcatctcagtcattatgaaactttgaacacatcagttaacttgtttggggctgcattacctgctgcagaatgacaggattaggccaatactttctatgggtcttccagctgtgacagtttgatgcccctctgtagcagaaatcccttcctacatctgaaaacatctcagccccagagccatttccatcttctgtacataattggcagtcagtctctcaggtcacagtgacaatacctgacattgtctcaggtcacagtgatcataccctgggcatgattatttgagcagcttcaacttttggagattatcatgcagagtttggctgttcctgctacaaactatgttttttatgtgttgaaaaattggactccttggtactgttattggaaaggcagtctgactttagtctgaagactgttcatcatttatcaggacccttaagttatttaaattttttatttagtcatttcataagatgacctggagaacataaatattcttctttgcagaaaattgctcctaccagtgctgatagcatacacatttggcttttgtttttaaatgggtaatctttggtttctcgtcaggaaccatttctcctgcccttatgcctgtggtctgacactactgttttctaaagaacatgcaaactgaccaagttctggagggcagctgtctgtttcataagggaacatggtgcttgcacgtaacttttccagctacgtgcagtgcagtaggctaggatatctttctggatgcctgtacgtggtcttgaccaatgtttgactatctgtttttaccgagtaaattataaaccattgcggaggctgagctgatgatgaagtgttgcaatcagacccaccttctaaggcttttcctccttcaaacagctatccttggcatcaaagagatatgaaggctcatactactggtcacttggtaggcagaggaatgaatgatgcgtttcattcatgattattattttctgaattattttttactactgttatggatataatcagaatagattctgaataacagaaaagtaaaattgtttgcgttctggtttcaaacagctgtctgtgagcaagagctgcaaggtatttcatcagaaactgaaatctaggaccaagttcacatcctgtgtaggtcctctatagagatgatctaattttaacttccatttgtaagtctcaaccaaactatttttgtgggatctgtatttcgtaaggagagaaaatgatgcctttcagtcacatagcaagcaattttgttatttaatgaagtgattttcacgatagtttcccttttgataatatagatactggcttttccctcaagtaataagaggataccctgtattttctttttttatttaaaatttttaagttctggggtatgtgcaggatgtacataagtgaacgtgtgccatgatggtttgctgcacctgtcaacccatcatctaactgttaagcctagcaggcattagctatttttccttatgctctccctccactcccccacccccgccaacaggccccaatgtgtgttattcccctacgtgtggccatgtgttctcattgttcagctcccacttttaagtgagaacatgtggtgcttggttttctattcctgagttagtttactgaggataatggcttccagctccatccattaaaacagtccgtagaagagcctggaatagtccctttcaaggccagcctattattatcagcagaggtggagcttttacctcttaggcatcctgggtgttggggaggaagtggtgaagaggaaggtggaaaggtgtatggagttacttgcatctctccacttgttgagggtgtgccccactgggacacccttcatatctgccctgaaggtcagcaggcactgataggaaagaagcaacagggacatcttcctcctctgccaatcaacttgccatcttttggaggtcacctagaaaatttcactttctccccacgagtagctttgtgcctgcctaccttccacgtgactgttagattaatactgttggtcattgtttcactgaccacttattcatcaatgtattcattaaactaaaaattgagcaactgctctttgccacacttcataagtattttcatttaaatgattgtatgagattttcacaacaattgtgtgcagtatgtggtattatctgtactgtatagatgaaaaagcataattttttaaaagagtaaacagtaagttgaaataaacatgtagataaacatgtaaatttgctctggtaattagagaaatgtaagttaaaacctcaaagtaccatttgccacccaattttttacaaattaagatattcaatactcaaaagaatgtggtaaaactagtgctctaaatatttatcgtattatttaaattggcttagacagacataatatatttggtttagagatagtttttttttttaccaggtttcttcctcttagggactaatccaaaatacgtttttaaaaaataaagatacaggaagggcatggaggctcatgcctataatcccagcactttgggaggctgagacattgaggattacttgagccacaggagtttgagaccagcctgggcaacacagtgagaccctgtctctacagaaaatttaaaaaataaaaaaaatcaaccaggcgtggtggtgtgtgcctgtagtcccagctgctcaggaagctgatgtgggaggatcacttgggcctgggaggttgaggctgcagtaagccatgatcgtgccactggactccagcctgggtgacagagagttaggctctgtctcaaaaataaaataagatatagacatgcctatgttgatagtagtgttttatttataatagtagaatattggaagccgaatgaatgtctaacagtagtagactgattaattttacttcaccttcttgatagaaaagtttgcatccatgaaaaatactaaatgtgaagactatatgtactaacatgggagaatatgtataatgtaagcaaaaaattcaggtcgtaaaattgcttgcatattcttattcactatacagtaaatcatatgtctgaagaaagactaggagagcatgtgcagaatggtcactgcattaccaaggaaagataagactgatgttattccctttttccctctttatttacaaaatacttgctatggtcggtatattccttttttaaaaaatgatatttattatctcatggtttctgtagggcaggagtctggatgtttctcaagcataaattggaactcagggaccctcttagcatctttcaaggctgcagtcaaagtggcagctgggctgcgttctcatcaggaagtttgaacagggaagaacctacttccaagcacttatggttgttggcagaattcagctgagggccccacatgttggctgttcacagcatggcagcctgtttcttcaaggccagtgggagtgcctctctccagttacagagtctggtgtattacacttttaaattgtcttttaaaaacatcctttccagtatcacgttacaaagcagtattttaacctagcactttttatcatattacagtgatcgttgttgagtagtgattctgatgtaagacaagctcacagcttgtgaccacaaggatcattatatgaactgcaaggatcattataaccacctcacatcgtaatgaagatacgtttatggaaggcttactatgtattggacacggttcagattttttaagctgtatttactcaagtaaacctcattgaagttgttgttgccactcttatcttcattttacggatgaggaaattgaggcacagagcctgagaaacctgtttcagctcaaaatagtaagtggtagaaccaccatttttacctacttactgtgagtgcagatgcctcactcttaaccaccaggcttttctgcctctcgaggtagtgggttggaatggaaggtgccctggcctcagtgtgtgaagtcctaggtttgggttcttgattgagtctctgcgtaaacttgaacaaatctcattttctgtatttgtaaagcaatgtaagcaacatatcttccccactttaattcatgatcattaaaaggatttcttgcaaactataaagtgctttccagtgtaaggtgggtatgctttctcttgggaagcaataatgtatttgaaaataagcactcaatgaaatggatacgttgatgggctgtaggtgaattcagtcagccaggcaagtatttggtaggccccatgccttcctatgggtacatttgctgaatttctttattcaaaagacatgaagtaagagcacagtttcagaagtgtttgtctcgtgatagggtctgtgtgcaatcagcgcacgttcatcaaaaatgatttaataaacaagacataggcctttgggtattttctcagcaagttgttctgtggacttgcaaatcttagcctgacagtggagcaggggaagtgagcccagagcatgtgggacgcaggccccgcgtcagctcaggcatgtgggcgatcgtacggtcagggactgaatgaaagggggccaagcagatccattctaaaagactggaatctttttagcaggcctcaaaatagaaccacttaaaaaaatgttccctgacatgatgggcattgactgtggagaatgttttgtggcaaagtcaggtggccctagagatgatacccgatctgttcttccacgcaaaggttttgaggcctgatggattgaaatcttcattcggtgtggaaaggatggttggaggcagagcacttggagttgtcgtgggaggcaccatcgtggtgggtatgacggtcacatgttggatgcctgctctagtctccctgccaaggtgccttggaggcagtctaaagggaagagccccggacacacccagctccagtggtttctctgaaatagttctctctgcttggagaggagaggctgtggctgtcggttccgatgtcccttttgctcgacacattcttccgtacctcatgtctttatggagtgctggctaattcaaccttgaggaaatggaagatggactcagccctttgtagatattgcaaatttaagcttttcatttaaaagtatttcttttatcacattacctgcaaatttatgctgtgaaattctaccagatgtgagctaatgaaaagctgtaaaggttggtccttctccagctttctgtagtctcagtttttaaccattattaatttcctcagattacttagctattggaggagataaccaataataacctgaaaatctagtcatttctttctcaaaatttggcaccttggcctaggtttccacatagaaaacccattttcccattaaagtggaaataggtcgctctacatggaaatagcagtttgtatggcctattaacaagtgttctgctagaccagcagcctgttaggcttcactggctatcgacatggtcatttagaagaaggaaatggatcaagtatgtgtgcttttgcctctctggtgttgtatgaggatttcaaacacagctgctcaggtgctggatgggatctgcccatctggaccgtccaacactaagcgcagaggcagaggctagaggaagagcatggatgcatgtgcggtggaatggattccagctcagttatttactggctatgtaaccatggatggcctgggaaacctcttgaagccactgtttccaatctgaagatggagagtgcatctaccctgtagggtagattatgcagagcctcaggcacaatacctgcttgtagtaagtacttaacacacaggagccgggacatttatcgcagacgctcatctattcatcagacagttactgagagtgttctatatgccaggcattggatagacaagtgcttccttcatttattctgaaagaagtaaccaattttgacctagagcagaaatcatggcaggaaggaaagatcttgcttgtttattagtgatgtcactgagggccttccctgggtaagtcacattgaatgttttaactggatgtcaaagccaaagcgtttgacattatcaaagggacaaaagaaaagaaggttatttaatgagagaatagtagttatatttctctcagcgatgttttattttgcagtgcactgagacagttcaaagattaattttaaaatgttcaccttcagaattattgttctgttaaccaagatggcagattttcagagaactaggagagcttcaaaatgagtgcttgtagaagaaagtgtagcccatcaaactcaagacagttgtggctaatgttagtgataaaaggagctttctccataaggctctaggtggggtttggcagttcgatatttgcttgccagtgacaatacagtctcaaagttcataggagtgttggtcctggaagctttctcagctggcatgaggtgtgtggaatgaccccccacccctgcggcctctgctgcaagtgctgctcattttaccacttgagttactggcagccaccatctcagtcttccgggattcctggcctcctctctagtgcctaccactttacatccacgccggactttccagcctctcaacaccccatcttttcccagtgtcgacttctcttgtgccatttgcttggagttccctgttagattttagcatcccttaaaccctaccttcagtttggttcctgttcatcctggctccgtttgtatattgacttttaattattctctattttttagtgaaaataatatggaaagtggagtcaagggatgtagatttcgaccccagtgtatttgctgtgttgctagcatctgagcccattactccttaataaatcaagataattctgttggctgggtgtggtggctcatacctgtaatctcagcactgtgggaggctgaggcaggtggataacctgaggtcaggagtttgagacctgctgtccgacatggtgaaaccccatctctactgaaaatacaaaaattagctgggcgtggtggtgtatgcctgtagtcccagctactcaggaggctgaggcaggagaattgcttgaatccgggaggtggaggttacagtgagccgagatcacaccactgcactccagcctgggcgacagagcaagactgtctcaaaaaaaaaaaaaaaaagataattcaatccactctagatgggaggttgtgaaggttcattaagatgaaagcaccaagccccattatttacatatggcagatgtaacagaaatgggcacacacatacatatatttttaaaataagagagagggtctccctgtgttgtccaggctgaagtgcagtgatgcaactgtagctcacagcagcctctgactcctgggctcaagtgatcctcctgcctcaccctcctgagtatctgggactacaggcgtgcacctccacacccagctaattttttatttttattttttgtagagatggggtcttgctacattacccaggttgatcttgaactcctgggctcaagcaatcctactgccttggcctcccaaagttctgggattacaggcatgacccaatgtgcccagccacatgttttttatttgttgcaaagttttacacacctctgcagttaatactcacttttccttaccacgtgttaaacctaggatagtacaggttaccatgatacactgtgaatttgtctttagacacaaaaattcacattcatatatactaatagcacattattctatgaacttgctgcttgattttctttaggccattggtaaatagtattctggaacacatggtgatgagcttgtgtagcctaaacacttcgctcgtacaggccataataaagtcctctttgaatggcttcacctggtggatgttcagtggagggacattatcatcattttgccagttctctgaagactgtcttatggatcttggcttcatgactccaaaatgggaagaggacagagccaacaggcagaactcagacaagtgctgggctggtaatcaagggagggctgtatatgtttcaacttcagatctcagggtacaagaaagaccaaccccacagggttcaaatggagactttttctgcaccctcactgaccccaccagcaattgcataggagaaaataagagtggtataggaaatacctaaggcagattatctgaggcttattttcttctaagtaaattccacatttgcagaggtcctaaaattatatcttttgtctttgcttttttatttttttactgtagtttatatatgtttgtgacatgtagttgtccttttatataaaacaaatatcactagacctgggcatgaaactcaggattagtaagccccattctctgcaatttgtggcatatgtctctgatgtcagctgaaatgaactttgttcagcaaaatggtttgtaaatattggtttgggtttggcaacaagagtgaacaaataagtatttctgccttatcctgagtttatccaaacaaacccaacagttttatatttaaaaatccaggcgctaatcgctttggtctcaagtgtatccccatctgcccatgtctattaatcatctgcagacctctttgcttttcacactgccactcagcacacaggggaagaaaacaccctctcagtggttaactttgcttgagaaactggtggggttattttacttagcacacgcaatgttaatgctcctgaaaacagaaatgttgaacaagaagccttgttagtgctgacatggtgagagccacagcagcctgtcccattgctgagagctaactggacagagaagcgtggggacattctctctggcaggacattctagggcctggtcctgtggccatccattcctctcttgcttttggcacaggccatttccaggttagctggcaagcccagtgtctttatttttaaacttgcagtcatttccatgccttgtgggaagagaaggtggtgaaaaggatcttttgttcctgggctaagcgtcagagcttagatgccaaggtattcctcaggccccctgaacttataatcaacgagaatgctaactagccctaagccctataataacaactggaaagtttggcctgttcagtaaaaaaaaagactgcaagagaatgttatctatggaaggcttggaggaatcaattgcatcctgagacttcacgcagtggaatgtgtgtattttaggattaagttgaacactttggggcatggcctggggttggacagaaagcccaaacagcaggcgcccagggagtggtgagagctcatggagggtgctggaatttgccatgctttccactgggccgtgtttcagggccgcgtgcataggcagaagtgagcctgatgcttggagggcctgtctggtattgctgggcactgtcacaaggcatcagatctccagaagggccgagcttgctcagttttaactcggggctggcacttggcctttgcatcagattgtgctgtcttccaattgggtccatgcacccctgaattcacaggaagactttttgaattgcaccctgggtacattactttatggaaattggcttctagatcatcagcttctgtatgtcctccttactacgattacatgacctgcctctcagaatgctcctggggccagctttaagccagctctcccttctcagctcccttcccaattgccttgttgccaccttacaaaaaaaaacataccctttaccacaccctccgtcttgctatcatgcatcatctcagggtgtgtgagggaatatgtagtttcatattttattttagaggtacatgtgcaaaaatgtttgaagacttttgatcagattcagcttccttgagcagtctaagtcaatactgtgcatagaagtaaaatgcaagacacaagtgcagaaaacatttggaattttaaactttctggtggccacattaaaagtaaaaagaaaatctcatatgttatgtaaatatatatatttatattattaattttcataatgtattttatttaaccccgtctatcccaaatgttatttcaacattatcagtataaaaagctagtaatgaagtgtttttgcattttttgtgtgtagcatgcctttaaaatttgattcatattttacacttacagcatatctatctcaatcctgatcagacatatttcaagtgtttcgtagccacatgtgactagtgagtcctgtattagggcagcactgttgtaagtgatagaaagcacaacctttaagctgatggtatttgggaaccaagattggttcctgctgaattatgaaaaaaaaccaacctgaggttgagaggcattaattaagagccagactggagccagactggagcctcgtctcaccacgtatccatcagctgggagatgctggacaagcacttagcctctgtttgcattggtttccacaatcaagaatgagaataataagtgccttcctcagaatgattgtttgaggattgaaaagctaaagctaatctatataaagcatagtgtctggtacctggtatgtaagtgtcactattattattattatttctggtaaaacccaccaaggtagccatgatgtggtggcaaaaactcgaggtttgtctctcagaagacttgcatttgagatgtctttctgctgttgatcacttcgtgccttaacttttcggagcttcagcgttgacatgtttgagtgagtctaacagctccttcctcccaggacacccctgctggaggcacagataatacaatgtgtatcatagctaccattttcgggaatcttctttatgccagtgtaatgcttattggtattatttcatcttcacaactgtttgaggaaggtgtttttatccccattttatatttgaagacagcgaggctcagtaactagcccaggttaccatgttgagcatgggcagagctggagtttgagtgcagctgtgtctgcctctgaagcccttaaacattgctacgtgctattgcccatgcgtatatcatgattattactcagacgtatggttcagttcacataatactaaaatctaagttaaacaaggaggccctcctatttccccaagatggcagagtaagctaatgtgaaatccctgctgttaaaaacatttggaagtgtcggtgagttcgatcagggaagcaggacaatgagcagtgctcttgttttcaggagacgttggagatgtgagggtgtagggctgggtgcctggaagagcagaggacaagtcactggtgaaggcctgcagcaggggctggagaggatgcctgtggaggctgcttctcctgtgtcagctgtccctggggggcacagaactggccatcagaggcaggggagtgaggacagattggagtgggcagggacagcttcatcagctgccacttcacgtcaccttccaaacatgcacaatacctgtagcagaccctaacctggaaccatccagacaagagaatctcaggaaacctggctgtgaattagctgacatgatgcggtaggaccccactgcagtggccaacagcgattcctcctggaaccacaggaagagcgagtccagacccatcgggaacactatccgttatgtttgtgggagccgtccatcctcctgctgcagttccagtaacctaaagcctgttccagatgactgttctatcatatcggggtcttggggtgctcatcctgtaccttttttcctctgcctgctagccattatcatgaacgctgttcactggtgtgctgtaaacttgtcttcagcccagctttttctgtggactccacagaactgtggaagcgctgctcctaagcagcatttggtgtacgtctgctgggtgtctgtgagattcccagcccgagcatgataattccttatcttgggggcttccgtgcataaggaaggtgtgttcggatcccaaacatgtgtgagactaggcccagggtttcagcatctcaggagagatttttgttttcctcatgcagggtccaggcagagactggcttcccatcatcatcctgagtgcatgagtggattttttttaacagctcagtttgatgtagggagtctcagttccagcttctgccttgcacagacccaaaggaatttcttgtttctgttccagttaaacacaacatataataacttacccacctcctcctgacttcccactgaaatgagaatgaagtggaaaaaaaggcaaaaatacagaaggacgggagattgaaagaggaggtcatggaaacaaaaatataaaagctgcaaaataaatggatgagtgataagtaatgccacagactagaaaaaaaagctgcaatttatggcggaagtatgagaaaccccaaagtaagctaaatagaagtgcagatccttagacaatctctggaattcgagccatcaggtatctctgaaacgagtagtagccgaatgtttgcacgagaagcagttcattgggtcccagcctccttcctcccctgcactgcctagtgaagcctctttccacacttccacaagagaagatggtgatacactttctggaaagtcaacctttctggaaacgttgaccgcagggactctgggatcaggagtaccaggcaaagctggaagaggggatggggaattccaggccaaaaacaggggttaagtgaaagtgtaagtatggaagaatgagacccatggttactgccccagctgtcctcttaggacactggcatccaacgtgatgcactcaggtgttcagaagattccatgccggggcctacaaacatcgaagacaaaggactcgcagatgttacattggccaaatcccccatagcaaagcttggcagctaagaaagcctgcccatgcacacggcacacggcactgccagccagcatcctgtgtcttgctcttacatgtgaatggataggcaaaaattagcagaaaactgaggaaagctcaacatgcaggacagagaccacacccccacaacacacacacatataagcaagcaaattctaaaaagtctggaaaacaacattcagagaagaaaacaaaaactgccattaatattcttagagaaatattataagattggcaaaacttaaagcatcagcattaccaagtattagttgggatatgggaaaaggaactttcccaacctactggtgagagcataaaccactgcagcccttttcaagagcaatttggcagtagagtcatccctcagtatccaaggagaattgtttccagcacccccaccccagcccccatagattctcaaatccacacacgcagaagtcccttacataataacatggtgtatttgcatatagcctatgcacatcctcccatatatttaaaatcatctctagattacttgcaatacttaatacaatgtaggtgctgtgtaaatagtcgttacactggattggttttctattaccattattttttgttgtattgttatttttatttttttcaaatatttgtgctctgtggttggttgactccaaggatgtggaacccgagaatacagagggccaactgtgcatgatagagctgaagacttaggaactctatgacccagcccatttcacttatagaaatccaggtacagggagactttccacaaggagactgtagaaaggtttttttttttttttactgtactgtttgtaaatattgaaaaggagggaacaactgtcaacagtagggggatggataaataatttaagatatagagtggaatattatatagctgttaaaattaatgaaatttatttacataatatggatatctaaaaaaagttggataaaaattgcagactataatatatatgtaaattttagtacctataaaatatatatattatttgagaataatagtaataagggctaacataaataataacagtttgatacagaggctattattaccattttacagttgaggaaactgaaggacagagaggctaagtaatctgcccaagcccacatagctagtatgtaagtagtgaaaggacaaaaagttcttgggaatattaacaatcttcataggaaagaagcaggatgacacgaaaacacgagactttatttgtaactttattttttagagataggatctggctctgtcatcacccaggatggagtgcagtggcaagatcatagctcactgcagcctcaaactcctgggttgaagtgatcctctcaactcagcctcccaagtagctgggacagtaggcatgtgccactcagtctcgctcattttttctcttttttgtagagcctgagtctcactactttatataggctgttcttgaactccttgactcaaatgatccttctgacttggcctctcaaagtgctgggattacaggtgtgaggcactgtgcccagccttttttctgttttgtttttttttcttaagagacatctggagcagttgtggccaatctggatgtctgttacattatcatgtttttaaagactttttctttttaagagcagttttagattcacagcaaaattgagcagaaggtacggagagtcccagctagccctgcctgcacacatgcacagccacctgcattattcacatccccgacggagtggtacattgttgtgatcagtgcacctacattggcacatcggtatcactcaaagtccactgtacggttccctcttgctgttggacattctgtgggttttgacacgtttaataaatgtaaccactgtcgtagttttctgccctaaacattcttgtgccccacctatttatttccctcacaaccctaacccctggcagccgctgatttttttactgtctccgtagttttgccttttctaggaggtcatatagttgacatcatataatatgtagccttttcaaggaaaagttggcttctttcccttagcactgtgcatttaacttccctctgtgtcttttcatagctcatctccttttatcactgaacagtatttcattgtcaggacatactacattttaaacttcatatgtttaaatattgtataacttttaatgattaaaactgtaagcttgggaactctcagcccacggctgactacccaagggccacagggctaatatatagccatagattctgtgaatcattgtgtgtatttttcactggccttccactaagcaccctctcatttaccgttctgcatgtactttatcagacacatagtgtcttcctgcctgtgatgctgggcctgaggtgtgcaaggggcaacactgtgaccttagaaaggtagtgctctgaaccagagcgaattcaaagggctgtcccttcaccgactgcatatcaggtcttcagagctgtgcttctagctcagggcaggcatttggaaggaagattttggaatcttgcctgaacatattcataatatgtttttcttaggttgggtgttttgctgggaattttggtgttatttccttcaacactgttgtcatctatgactcagaatttaactacttgtgcttttttgtgtgtggcttttatgctgcaggaaatcacagtgaatcctcttatctgcattcttggaggcagggcatctgataaattaatatttttgttaatgctgctatgtgacccatatgcacagtgctttcaaagagttcacaaagttgaatctgggggtttacagttggaaggatataatttatacaccttccccattttaaaaatgaagaaattgaggctcagagactggaataacatgtgcaagactacacagctcattgcccatggagttgggggtagaaaaatgggctcccttttccctatgtgtgtttactgcatcacagagaacaataaaataaaaagaaatctatgatttcttgattgaatttcattggttgattgataagactcctcaatagggctttataggtctaaacctccactttggattgccgtatttgtgatatgtactcagaacactagctctgaagctttttaatgctttacgttaaataaaagaagctcctgaggtgaaagttggtggtttataatattatagaggtgtttatacacctgccttagttgtgtaaatatagataccactgggatcctaggttttcttcattttcactcaaagggaaagcctctaccctgatgctctagaattggatcagaggcatatgtgttatttttaagcttacaggccttactcccattgggtgggggttattggcaagaggagtttgatcattttcatttaagaaatttaggatcgctctgtcttgtgtttttacaacagtcctaatctgaagtggttgggtgacagaaacttctaagtgggtaggtgctacacttagttatatgatttttttcctcatagcactcccaattcatattccttagtggcccatttttaattactttgctggaaaggcaaatcgatattttctgccagaactcttaatgattttcattaatattaggatttcaaccttacatatatataatacttgtaaacaagtgcagcattccctgtgaccagagaaggtagaaaagccttacttgaaatggttccatagaatcaagtttagtaaacgtgggtatttattttgacttaaggcttgcttccagaaaatacctaatacaacaaaggaatcattaacaaactacctataaaacatgatcatatgtaaaatgagagagtaccttaattttgcttttataacatgatttatcttgcagtgtgtgaacttaaatctccctccatgagtgatttcctgtggggtctggagaactctggctggttaaggcacattaaagccataatggatgcaggaatcttcattgcaaaggtatgcaattgcagagaaaataaattaagggacagatgagcaaaccactgacttcaaaatgggtatccctctgccatgggcttccctgtcttaagctgcactgcactgactggatagccagctttgtagagctccgtagtctgtgcgctgaagatatgattttgcgaaagaatacaatgcttagctgatagtgtgtcagcactgtgatcaaatggtaaaatatttccagagtattctcttccattaggcttaatcctggatggaggaaagaattttctgtagaatacaaccaaatgtgagttacttcagtgatggggcttggggcttacatccagtagagccttctttttagtcatggcataagcaaaagtcatgttcctgtagctggaaggtagagtccattccgccataggaaaatgtcgctgcagctttcacataagctgttttagaatgcaatgtcttttgtgttgttcagttttttttaaagaaataaataccttggatttatacctaaagagaaccatatcttccctgatgccatggtatgttccctgttttgaggtaatcatttattcaagaaatctttatttagtgccaggtactattctagattttacagatgtgatgtgaataaggcagatcaagtctcttccctcacagagcttatattctgctgggggagacagagaatttttttttttttttttttttttttttgagagggagtctcgctctgtcacccaggctggagtgcagtggcacgatctcagcttgctgcaacctctgcctcccaggttcaagcgattcttctgtctcagcctcccaagtagctggaattactggcacgcgccactatgcctggctaatttttgtatttttagtagagacggggtttcaccatgttggtcaggctggtcacggactcctgacctcaggtgatccacccgccacggcctcccaaagtgctgggattacatgcgtgagccactgcctccagctgagacagagtattaataaactaataaaactagaattttaggtagtgataaatgctatgatgaaatctctcccatgtttcccagcgtatgttaactgccaagatatttagtaaaaaatgatgtgcatttgcaatagcaaatagatattcttttcttactggagattttctggtgtcatttttacttttgttttttcctttcctcaaccttacatccattacttgacgcttaccttttatttataacttcataggtctgtaatttataacttttttgccttttcctttttggaaatggctggggccagtagcaactccagaatttcagtaaggcttaatgtggaaactcagaggggagggaagagggttgaaggtccgtttgcataggacgaatgcttatgtttagtaagtacatgcgcttattggaggtgacttgagtggtggcttctggatagaatgggaagggaaagctttagctgccagcaccaggccactctggctctgccctaattagggggggccctaaacagacgaatggacaggtgtttcgttttggctgtttctttctgtaaatatacagtcaaacctggctgtgatgagaggttctgcctttttacagccattctttgtgactctttgcggatcgtgtgttttctaggcagtgtcagaggaaggggcaagtgtgcttgttcactgttctgatggctgggacaggaccgctcaggtgtgctcggtggcaagcctgctgctggaccctcactaccggactctgaagggcttcatggtgagtgtggccactgggcgattcccacaggcggtgccttgaccaggaatggacccctgtttttacaactactggcaactgctgttttcttgccagcattatttttcttttagtagctcagcaagattaaaggggaagagatcaagattaatttaatcagcaagattaaaggggaaggcttggaataaagagatgaatttctgggatattgaaaccatttcaagtcaatgctactgaatgagttttggggcaaatataaaatatatttggtagtttgtaagccaattttatatatcatttgctcataagtatttcaagtttgaggtaacatgaatatgtaacagaagactttttagaaaaaatattttgggaagaaattttctatattgtgtatgccaaaagtccttggtaggaaaaactgttttcacttccagggtatgttttttaagtagtccttcacacccctggatgagaatgctgaaaatttcacagccttttgttgttgttctttgctgaaatgacgagtatatcctgtagagtttgagctttttaggtgggcatcaaatgtaacgttgctttcaactacagagtattgtatatagttgcctgggatggtgaagttttcactaatctggtataagttccttaaaatgaattcacctcttaaccatgatttggtagacagtgcttcagtgaatcatgaatccgtgctacacaagatgctgacaaaggagtcctaatggaatatctttactgctgggtctccattattgagtaatatcagcaacaccctcggacaagagcgaagaggcaggctccctctctgggatgtttttctttttttggaagtgtctgagaacttccaattacctgtgatagcattgacacctcaaagtgatacccttgcttcagatccctgctggactgaagtcaggagggctggattgcttcatttgcatttggagagtaaagaggttgccagtcacacactgcccttaggctcttctcctgcacacatgcgtttccatcatcaacttgttctcattgtgccccattaaacttacaacccaaagaaaatgtctcgagttgtcaagaacagacttccactagttcatatttctttgtaaggggaaatctctggccactttaaagcattggggatattgatgagactatccatattacttgactgaacactttttaaaatccaggctgggtgtggtagctcacacctgtaatcccagcattttgggaggttaaggagggaggcttgctggagccccagagtttgagaccagcctgggcaacatggcgagacctcgtctctataaaaaattaaaaaaaaattagccaggtgtggtggagcccacctgtggtcccagctacttgggctgaggtgggaggatcgctcgagctcaggaggtcaagggtgtagtgagccatgatctcatcactgcactccagcctacgtggctgagtgagatcctgtctcaaaaataaattttaaaatataaaacaatataaaatacaaaaccaaaataaatacttaaaaataataatctggactgcctcagacttagaaattcatgttaaccctaatttcaaagcagggctgaagctttgaatataccccaaacaccatcattttagaattcttataatgtgtagaaaagatcactgaaaaacttcccagttgtttttgtaaagaggttggtaatttacattacactgagaggcagcatcacacattggttgagatagggtttgaagtggagagacctgggctgtgaagtggggtctccttcctagtagcatgatcttgggcgaatatgaaacctctttccttcggtttccccttctaaaagagtgagaatacctatcctacagttagagatcatacgtaaagcaatgtgaacagtgcctggcacataggaagcattcagcgggtggggttcctgcatttttatacatccatttccactcactgttcccatggatgaccttcaactttgcctttgccatgtgcatctctatatgggtggataatgcctgttcatgcatttgcaggttactcgaggatggggacttctgcaagtgcctctgaattcctcaacattattggttgtgtggtctcttatttttcgtttgcttctctccaagatatttgtattctttcttgtgtaggtattaattgaaaaggactggatttcctttggtcataagtttaatcaccggtaagtaatatttaagactgttttgaatgtttagaataaaagcactgtttctgaaaatttcaattgaatatttaggggaaaatcgtcttgttttttgagtttgtgtctcttattcagaaagcttaaattttgttgtatatgtcatatcatagataaatgaagttataactgattccttttggtaacagttgggcagaactaactaatgttaacttgttctagaagagacagagaatgcttgttcattgtcttagtgaggatcagccttcccttcctcctgccatttgcatgtgacttactaaattattccattttagaagtccagagattcactttagtctgcaagttgtgaactgcccgtggaacagtttctctttgatcttctatagtcctaaggcatttgtatcggagtgcagtttgtcccagatgtctctggagtggtgatgaaggcttcagaaccagacatatccaactccagatccaggccatgatattcactgtctggccttggacgtctgggctgtctgacctttggtctctcatctgtggaatggggatgccaaagctgttgttttgggagtcaccagcctccttttgtcagtgttgatgcctgtattgtgttctggtgttctctactctttgaatcttaaatggtatagctgtacttagtttagtctttggtgataaaatttaaatttaggcagcaagtttcattagtttgatatatattttcagaagttttactgtgttttcttaaaattctaaatgcatgcaactgctcaagtatatttttgtagttttttgcttttagcattaattgatcactaattctgtgattttcaggaattctatttttctaattttttccaggaaagcataggaattccatttaccaatgagaaaattaaagcccccaattagataaacttcttaacatggcattattttcagtttggggttctattaatattacacgctaggcagttaggatctccaagataggagacagatgacagaaagaatatggaaatgactgaagatcagctagataattgtttgataaggaaaaaatacgttaatattaggcaaccttttttttttgatttgcagtaaagtttattttgaaataattctgaagccataaaagactaaaattccctttatgcaaatataaatcagtctcccataatgcaattatttttttcttcctcattttatttttattttttaattttattattattatactttgttttagggtacatgtgcacaacgtgcaggtttgttacatatatatacatgtgccatgttggtgtgctgcacccattaactcgtcatttagcattaggtatatctcctaatgctatccctcccccctcccgccaccccacaacagtccccggtgtgtgatgttccccttcctgtgtccttgtgttctcattgttcagttcccacctatgagtgagaacatgtggtgtttggtttttttgtccttgcgatagtttgctgagaatgatggtttccagtttcatccatgtccctacaaaggaaatgaactcatcattttttatggctgcataatattccatggtgtatatgtgccacattttcttaatccaggctattgttgttggacatataggttggttccaagtctttgctattgtgaatagtgccgctataaacattcatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgatcgccattctaactggtgtgagatggtgtatcattgtggttttgatttgcatttctctgatggccagtgatgatgagcattttttcatgtgtcttttggctgcataaatgtcttcttttgagaagtgtcttttcatatcctttgcccactttttgatggggttgtttttttcttgtaaatttgtttgagttcattttagattctggattttagccctttgtcagatgagtaggttgcaaaaattttctcccattttgtaggttgcctgttcactctgatggtagtttcttctgctgtgcagaagctctttagtttaattagatcccatctgtcaattttgtcttttgctgccattgcttttggtgttttagacatgaagtccttgcccatgcctatgtcctgaatggtattgcctaggttttcttctagggttttttatagttttaggtctaacgtttaagtctttaatccatcttgaattaatttttgtataaggtgcaaagaagggatccagtttcagctttctacatatggctagcctaggtaacactttttaaagctaccaaaggtgagaaactgtaacatctgagaagtttctagacaatttccaatgttcccactcttgggaaaactctaaaactgatcattgctcattcctcttcctcaaggtgatgatctcttactaacacggggttctatattgttattttgtctttgatgacaccaaaacatccttttggattctctgtaaaactcacacagtagtgtaaagggctaaggagtcttcattttaaaatcaatacaaatttgaggaagacgagtctgatgtgctcttgaaaagcaaagcaatgggagataaaagaaaaatacatgtggaatctgtcgtcacatggaaataaatcacgtgataagctttaaccgctttaggaatgggaatattcttggcaacttgggaaaccactatttttttttttcaagttgtctttttcctcatcccttcccaacaaaacagcgcaaaaaatgaagagccttaaagttgtctggacatttcttctcacccgctcataaagtgcaacatttattttaaaagttctaatgtacttttaaggaatgaatttaaaaatgccctttttctgtggaaagtgtctttgaattttatttcttgcactaacactttcttttgtaactataacgtgaacgcatcccttctatccagaccgtcactacaaagttgctctggaaatttgaatttaaaatcttaacttttctaccttttttgtcattccaagtttgtaagataagatttatttaggaactagggttgcttttatggttgtttttgcatttatggctttgtactttaaaaataaatctgccttaaaaagtctctaatgctttgttttatagatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagtaagtgttttggtgtttttggtgtttaacttttatttaaagattttgatgactgagaattttaggtggcctttcataattttgaagacttttttcatttagtcacatacctatactgacagattagttttattttctttttcctggtgtcatttcataaatggtttaaatgtcatcaactgacagataaatagtttcattttttccttcagtttctgcctgatagacagcttgacagacttgatgcatgaatatcgaaagggaattttctggagtcaaaaaagtggtttttgcatttaaaaggaaaaggttagatatatttggtggctatgctaccataataaaaattgcaaatttaattgggaaagcaaatataaaagccagaatttattcagattaaaactgtattgatttatccaagggtaaaagtagataaattgtggactttaaaataagtgacagtaaaaaacttacaacaaagtgatttaggcagtatacatgagagaacattttttaaattttcataaaatgaaatggttttaactatggtgtatacaacattatcagatttaatttggggaatgatcagttcaaatgaaatggactcataaagaaaattaatttttgtagtggatactagtttgttttctctaaggaagctcaagtgtgattccatggagatggagatgatttagaaggagcagagtgtatcctttagggtcacctgttttcttgtacctgactagccaattctaacagtatctgcttgggtctgaatatggcttttccacttactagctataggactttgggaaaccacttattctctctattcctcagtttcttcatctgtaaattagacagagctcacagcaactcagtgaggattaaatgagagaaaacgtggaacatttagaatagtgtgtgacaaattataaatgtccaatgactatttgggggaaaaaactccccccaaaagaacagcttaacacacacacacacacacacacgaatcgaacaccttgtcaaggccagtacagatggtggtgaagttgagattattacagtgttctccctctataccatgaagtcaccaagatgatacatttacctgctatcgaacagacacgtggttttcaggtaacaattattagttcctttccagcattaatataacatatctactgtgtgtaagcaccaaaataggtcatttatagacttattttctttataacaggattcaagaaagaacatactcattatgggctcacctgtggaagaatcgggccgactacctgaatcctctgtttagagctgatcacagccagactcagggaacccttcatctccctacaacaccatgtaacttcatgtacaagtatgtaaatccttggtaactttgtagccatggtatgaacttggattctggtaccgtttaacattcagaggtcaaagtgtatgacactgatctttgaggcttttattggacacaaaagacaccagagggagatgcttgaatatctgatctggtatttttgccagtgactcctctgcctctttattcctcctaaatgtggaattttcttcaggaggtgatgttttataataatgatatcataaaaaggttaagttccaatttatttttttaaaagcaaatgaaagagaataatgcaaatgccttaagtcaaatgtggaatcacaagtttcaacagtgatcatgacgtgttaaggttggagcaaaaataattgtggtttttgccgttatacaacaaaaaggcaaaaaccgcaattacttttgcaccaacgtaataggttgcctttttgtctccactgaattaagtcctactggaagtacttcccttgtggaaattacattaagattgtatgtattagccgaggcgggtggatcaccctaggtcaggagttcaagacaagcctggccaacatggggagacccagtctctactgaaaatacaaaaattagctgggcatggtggtgagcgcctgtaatcctagctactcgggaggctgagacaggagaatcacttgaaccagggaggaggaggttgcggtgagccgagatcgtgccattgcactccagcctgggcaacaagagcaaaactccatctcaaaaaaaaaaaaaaaagattgtatgtatggggagaatggggagagcagggtggcatcctacaagttctactaggtatgtgctagatacgtatgttttttcctttggcttccttgttaggcttgtataatatgaaaaaactcaaaggtcagcaacatcaaaagactcatgcagaataaacagaaaccccatctctttcttcctactcactcccgacacagacttgatggcttttctccctgtatagatttcgtttctcaaggttttttttcttaattatttcaatctaattatcttctcagaatttatagcagaatattctatcatactaaacaaaagcctccatagtgcatgtaagacaagttttaagagctgttgagatatgaccagttggattgcaactaatttattattaacagctagtcaacacatattttattgaggatcaaacactgttctgggcactgcagataaaacaatgacaccaagtccttgccctcaaagtacttacttatctacataaataaaatagtggttctaagggtaactctgtgataacaccatttttctcatttgcactccagttgcttttttgtgtaggataaaaagggatttattggtcaggcgtggtggctcccgcctataatcccagcactttgggaggctgaggtgggtggatcacctgaggtcaggagttcatgaccaacctgaccaacatggtgaaaccctgtctctactaaaaaaaatataaaattaggcatggtggtgcatgcctgtaatcccaggtacttgggaggctgaggcaggagaatcgcttgaacccgggaggtggaggttgcaaggagccgatatcacaccactgcacttcggtttgggtgacaagagcgaaactctgccattaaaaaaaaaagcgggggggggggggttattgccaatgcaaatgtcaacttttagtggtcgtgatacaaaagataaaagctgcaagtttaagattccctttgtagctgaaagattctaaatatacaatttcaaagttcaaaactaagagccattttcttaaaaggtaatggttacatgtactattttaattttagaaaaatgtattctgtgctaattcatatatacaggcagacttttcataaacttattctccccaaaaggcatttactgacccaagaaaaaaaacatcaacatgaaattattaccttaagtagtggcttttttgaggctgaaatttgcatttggttattattaagactgtggtatcatagataccttagaagacttgaggatgtgaattttcagactgtgataaggtggtatcacgacgctttgccatcctttccaggttttggagtggaatgtataaccgctttgaaaaggggatgcagccccgacagtcagttacagattacctaatggcagtgaaggaagaaactcagcagctagaggaagaactagaggccctggaagaagtaagacatacttgctttgttaatctattttctgtgcttatttcttgaagagcaaggcttcatgaaagcctcttaagattcagtgcaatacaaatatttcacatttttagtcagtagaacacctgaaacacaaccccatccaggtcaggactcagataaccgaagcccaaacctaggcatttaatgcatttcacacatctggtttgtggctcagttccacaaatttttggttgttccttattttaggtcaacttgtttggttactgttatttgagagtagtaaaattaatttttttctggaaagtgtgaaaaagtaacagaataaaatcaaatatatgtacttgtaaaactctttccccacttttagaaattatgttaactatgatattaatctataattggtaaaggggagactgactgtaaagtcttatcttttggcttctatgaacttccctgtacttggacagggaggttataataaaatgcttttcctaattggataactttgtttccaatggtactaatgtagtttatgaacatcttaggattctattagtctattctagcagtctggctctttaaaactggctcttccttattacaaagtcaaaattccttaggctggcatttgagattttctcttttcagctttattttccatgctaatatttaatggtttttgctgcttgtatacaatttagaccttcctacctttgtgtttgtcctctcactgtccctactcctgtcaggaatgcttactagctatcaccagaatgtccaagtttaaatctttcacagtcctgttaaaatgttccttcctccctgaaacttactctgttcttttccttctaaccttaccacttcatccctcttcaagaacttttgcctttttgaaattcttacattgcatgaactctgcctctctctgctccactactccatgttccttaaggctgggtctgtatttatctatctcttttcctcacactgcccagcacagtgcttttgcacataacctaagtgaatggttttgaatgaatacataatacttgatcttataacacctcctgtgttaacatcaaaacatgaaatctggcgaaatgtattctgaacaacccaggtgtccataacatgatgaatggggaaacaaaatctggtatatccatgtaatggaatactgttcagccagaaaaaggaatgaagtacttgatacatgctgtaccatgaatgaattctgagaacataagctaagtgaaggaagccagatacaaaaatccacatgttgtatgattccattcaatttatataaaacatctagactaggcaaatccatagagatagaagttgatcagtagtagccaggggctgtggggagataggaatgggaaatgactgctaatgagtatggggttttctttcggcaggggaggtgatgacagtgttttataattagtagtgatcgttgcacaaccttgtgaatataactaaaaaccactgaattgtatactttaaaagggtgagtttcacggtaagtgaattgtatctcagtataaaagttagatgataaacacttcattcatgatttctaaaaaatgttttttgagttcatgggatgagactcatcatttgaaaccatgtaggtatagaaaagagggagactagggttcactgggtgcttcaactgtgctatattgtttattattatagaaaacctatgtcaaggcaggtattatccttacattagagataaagcaggcctcacagattttgtccaaggtcgtgaagtccaggtttgaactcacatccctctgagtcacatgttcttaacattatacccacgtgggaggtaacaaatgctaaagacatgcatatatagaaaaagataagttatttatgatttttcccctgaaattgttatttctttcttagaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcaggcataatcatcactttaacttttccttggagcatatattttgaattgtgagaataattttgttgcttttctctgagatctatagtctgtttctcctcattatttaaaaatgctaaaccttgtatctcactttttctctaacactgatttaatagctaacgaggtagaagcaacattcattctcctggtcttacatatgaatttaagtatcagctttcttgtaataaccttttattactgttctagagactacactaccgacagtgtgggccagccaccagcctgatctcaaagtatcacattataaagttagtagataaaacatctgtgagtgaaaatccagtttcaagaaccagagaattgggttgtcatgtctgtttaatgaagggaataggttttgtaatctatcattttagaaattatgtaactggctaatatggtttaattaaccttagtaacatctcatgaccactgactgctgaaagttctgaaaagaatttttgttttgttacactgcacatttaagggagagtccctcccctatcttatgagttaaaaaagacttcactaggtgacctaaattaaacttagtggggaaaagtggccatgtttggacataaataaatggtattcacactgtatggttttaatatattagtacattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgagggcaagaaagcaacattgctgatctctctagtatgaaagatttggagggagtgttgcaatatatataaatgaaaacatttaattgtgttcatcatatttaaaaatatagaatatattagagaactgtgatttaaaagtactgttaatgtaaaaaataaagcaagtgtaattaattctttcagaatataaaatttgggcattctctgctgagcagttcccaaattaagtacaaggaatgtttattcattttctgcaatatactatatgtaatagggaataccttgctaaaataaaacttaggatatagtggtaatggctttcacatttttataacataacataactcacttcacaaccttcttggagctgtccactcttagaaactctgttgcctaatattgaggatgtggctttaatttcttccgtttgacagtgtatgtctataaaaacaataaacatttttt

SEQ ID NO: 19 - DNA, 51424 bp, Homo sapiens
gagagagagagagagaagaaggagagcgagcgagcgagcaagggagcgagcaggacaggagcctgatcccacagcaggtagaaacaacgaaatgtttttctttcagggtgaaaccgcagcaatataagagcattattattatttttttcccgctgtctttcttcttttcttctcctctttcttaggcatatttgaatgtattccgcagggtgggtggtggcatgttgttttggtcttttatttatttatttatttgcaagggggagctggggtgagttggggaggggcgtcgggggccatcatctaaagttaagacgctgggacggaaaacctgtctcactgttccatcatcctagggaaggcacgctcttgtcctggctgcaaaattgcctgtttttccctttccagtggacgctggtgaaatgccctcttgtgtaggggtctctcccattctgaacacgaaaactcaacttagtctttgatatggatggcatgggatggtaacgtttggagcgtgtgtctgggggagggggaggttgaaggtagaaagtggtaagactgcagcttagcctttcttttaaactattatgtttgtatttgcaagaaactttcttaacaactgaagtgccatgataggtttgtttttctcttttaaaaatgtcagaagagggcaaaaatctatggtgccttgtcaaatggttttgctgtgttttgtttacccattcagatattcaatctttttaaaaagatcaacaaaaattaatagggctaagaaaagttgtttttcccttgtaacaaacgatgaagattagtaaaagggtaaattaaaattttgcaatttagatgtagcattttaacataatatttatccaagatttcttgtcatagtcaactaatctgtttcaaaaccagtcactaaattactaaattaaggaaaagctatgacgaggctcagagttcttatctctagaccatttcgctctaaacatattatgtttcattgcttacaagcctgtttgtaatggtttttagtgatttaaatgatttcccgagactgcagaaagcattttgtagatgtatttaaaggcataccacattaaactatagagggtttaatgaaaaagaagctttaaaagattgcagtctattaatcacttaccctacaaagaaatatagattaaatactttgaacattccttatattatgactggaattaattacagcacattaaaatgttaccatagctgctccttatccaggtagtgcattgaatttcgaaaactgactccacacatagactatatacatttttaattctctaagctttctgtactcttccagttctccaacattccactaccaagtctaaattcaacaatcagatggtgattgattgcactttacctaagaggtaaaaagatccctttattcatgcaaagcaaagcactccagcttccatctgtttgagatgaaacattttctagcagcaacctggcagaatttgagagggcttgaaagatatgtgtgggcatgtttgtgtgcatttgtgtgtgtgtgtgtgtgtgtgtgtggtttgtatgtgagagagatcagcacatggcttgactataaagtgtgtcctttagcttcacagaaacattaggaagcatgtttaacaaagcagtcacaggaacagaataaaagcacgactccggcattcaacagtgtgtttcctatgtttttaaatagaaataaatacagttgcttctgaaatcaaggtacctgcagaattcaaagaggaattcagccatcacaacatgttaacctatcccctccaatccctaaatatgttcttcctgttagagacaccagcttaaaaattttaatgcacagttcactgtggaaactgaaatcttaaaagtccaaatatttagatgataaacaacaagaagagaataaaccaaactatattctaaatataaaacctagagataaacaactcacagtttttatgttgagcaatactgtcacctgaaagcgtttcagcttgtattcttttacaggagaataaggacactgatatatttctgaatggagaaatggaagggaaagtggagaatggatggtccaggtttccattgcttccaatgaggtgtcatatcccagtgaggtcatttcctgacttcaaagcattcatctaaactgcctcagtcagccctggtggttataacctgatgtttcttgctagagacattgatctctacttattctacttttcagctgctccagcccgcgatgaggaaaagtccaggtctgtctgactgtctttgggcctggatcctccttctgagcacactgactggaagaaggtggggacacttttttaaaaatctgcatgaaaatttctgtaacttttcatttattttatcgggggaagaaaattgtcctcaaatgaatttatgactaagggaattcagaaaacttaactgcaataatttccagctaagaataaagaggagcagtatgaaacaaatcattatgtttgcacgttagttagaatacaattaacaagccattgttaagacatgtattaattcaacatttaagtcttagattgaacttctcactgttcagttggaactgaacaaaacgtgcggtttcctaattcatagaaaaagttaccccaattagtggttgcatactgtgtaacctgatttaacaacaagaaaatttctagcctattgtaaagatcatagagtaacttttgtgtttatagaaatggaaagttttaaataatatctgttatttgaaaatcacgtctctctaaatgcatatgcatatcacgttttgaaattgttatctatataactaataaaagtggactatatgagacaaatatttaagaactttggtaaaatcaaatttccctattaaaaaaacaattactaattgtttataaagcttaatcatagtcaaaatatgttctaatgatccaatcaagcatgtgaaattaatataatagaaactatttacatgactaagtattacagatttttctttatctgcttttgtatttcttgtgtagcctattcctgtgacccataagaaggtcagacatataataaaaacatgagtttattcaaaatgtaatggcaagggaactcttaagagttaagatagggagatggaatagtctggaaagacatatgaatttaggaagatttattttaattcagaagttttctgttgttgttttttgctattgtgtatggtaaacactgacagacaggcattattatcagatatccttaatgagagaagttaaatgtctttactgcttttgaaaaattatatgaagtgttactattgcaatgacctgtagatggagttagtgcacagtgttttattatatagtggttcatatggaatcaaaatcaggtaatgtaactggcatttctcttcaaaatatatattcagtttaggaaacactacattgggatgagtgtttaatacaaaatgaataagcatcttattcgtagggtttttttctggcaattaaaacttgacatagtaagttagaagtaaagatgaaatgtcattaaaaaatcacgtaaaataaagatttccattccagctgggaaagcagaactggtcttggggaaaaggcagtggtctctttgggcatctgcattccaatgcaaacaattggtgaaaacatttgtaagacaaaaccaggaagaaaagcattttctgaattttatataagctgtaaaaacttagagggtgtagataaaggtaataaacactctatattttaagaattgttttaataatttaagtttatttagtcatgttaccccatttcatcttttatttcttcttattgtattgctttcttcctcagagttcccgatcagggcctcctcacaacttagggtgttctagcatttattttccatctttatcaagatgaccttccagcatccttgaaagatgcaggaatggcagttgattttgtgacaatgagtttttataaataattgcattcacaaaactatttttgccttactgttgtcttctgccaatgagacatactggaagacacttagcttgttgaaaatttgatttaaaaaaacagcaagatgtttaattttgccaaaagagagtaagccctcaatctgcatggcatcaatgttgaaattaggagaatgaaaaattgtttcaaagagacacattacatatatccaatattatggatagcctttagttttagtaactttatcaaattaaaactttatcagaataatagccattgcattttgccgatacgaaattaattacctgcaaaacagtgtttgtttttgaaatgattttttgatcatatatcttgctgctgtcaaataagtgaattctggcttcaaatgttactatttttcttatatttatcagtaacatcaacacacaggaatgaagcccaaagtatattaagtagaaaatacaaaagtgatatatttgtggcagtttcttagtttacaccctatattcattttgcttttgtactcaaggtcagaactatgattgaaatatatcagtaaatgtgatccatcctaagatagaaaacaattctctcaaaggattttggagttgtcatgctaatcatcacataaaatatgattcaaggagcatagatagcaatgtgattgatgtaggaaatacacaatttttgaactgaggtcactatgtggtcgaaacacaaagactaataatggtaagggacacaggctacatctccaactagcaacgtttaaatataaataattatcccaatatagaagaagaaaataaagtttcagactagaatttgaagaaagctaggttctaggtcaaggtttgctcacaaataggtgtgccttcttaaacaaaacactaaaactgtgctacagcttagtcaaccacaaattaagattattgaacttgatctttctaaaggttctttttacatctgagactagaaataataaaaattaattagatgtttgagcagacaaattttaatcattgggtcatgaatcttaagaggaatggaaatttgcacactgatgtaaaaatataattgtcctaagaaatgttttacctaaatctcttaaaagaacatcaagaaaatcccaccaaaacacagacctatatgaagtgaatgaaggaaaggatgttggtaggtaaaaacttaggcttttgctgcatgttaaataaaaaagaaaatcagttgttttggtaactctttttaatttggaaagaactttcctaggtttgttttctctatttttttttatgtgcattagcattcttgcttgctcagagaagacgtgcattgcaacgtaataaacatgataagaattcaaaaagtaaacagacagaagtcatttcttacaattttcctttcacatttaaaaactgaaaattaaaaatataattaaatgcccagagtttaaaaataacattcctttttaccttgtgaaaaaataattttcaagttaagattcagtagaaaccaaagtagaaaaactgagaaaggatttatttggaaagaggttttagtagaaatgtataatttagctattgcttctctttatgttttttttcagctatggacagccgtcattacaagatgaacttaaagacaataccactgtcttcaccaggattttggacagactcctagatggttatgacaatcgcctgagaccaggattgggaggtaggttgcattattgtatttttgttttagagaataatatgagatctttactatcacagccttaatttacctctaaatggtcaaataataaaaatggtgacatgtaatttaatgacaaatctatttttaatggatcactctatgttaattcaagttactctgtagtttcatatccatacgtagtaaaaggcagacacaaacttctaataatgacacgaagcagatgctacatttatatgataagcacagtactttctgtgtaacgattttatcatataggtaaaaactgggataatattctatcttccagcacaatgactgcagctatctcacctggtactggtatgtttgcatttaattccaacaggatatctttgattctattggttcaaacatttattttggaatatttcatattgatccactattatgtgttaaattgccaccacctctaggataataggggaatgagatagatggtagtgttgtggtttaactgtgcatttgaacttataccctaattttctgtaatacaattttattttacttggtatatcaattactcggttatattgatacatttctgcttaggaagaagacagcacttaataacataatatatatataacaataagagtaaatagttctaggaattgcacacatttgaataacacttgaataagataatcaaactatcttatttggttaaacaaagactaatgaagccaaatcaaaatattgatctcagagtaaaacaagtgaagcaaggaaataaattttctttcaaagtcacacagaaaaccaaggttagaatccatgattcccaactatagctgatactgaacctttcctaaagcatttgtagtagctatttaatagcaatatttaaatagtgattaaatggcaatattaagacagccacttcttcttcatttagacagcacagataagcaaagaataaaaagcttacaaattcaaacaatgatttttcaactaaatggttgcatggatttacagttacttttaaataaatattttgcacagtataatgacatggttgtgtattatgggtctattttgaagctgccaaatgtcattagagtctcagaggtttaagggaaactgccttggcaaagacacaacccaaatatatgtcaaaggtcttaccaggtgtcctttctaatcaatttcaaacattcattttaggacatactatacaaatttccccaggtttagacttcaccaagtttatattgaagtttttagaaaaaattctttaagtcaaaatagagtggtcacaaaatggggagcctaattttgtatatgatatgttaaaacactgcttgtgtacatttaaacatctcaattggcttcaaattttttttaatttataaaatttgcgataaattacaaaactagctagatgaggaatgtatgaaaagaagaaatagccaggctagtgatataaattttacatagcaagacttttgaaaatactggttgtaatgtatctgattactttacctaatctcctccctaccctatgatctcattccctaaaaagtcagcagaattttacaacatatttaaaaaatttctcttcatcctagtttagaaaattctatttaatattttggcatgtaaatatgagtattatttgacagatttgtgcatcatcttcaatttattaaatagttttacacacaaactgttaaaatattagccatgtggttatattattgttcagagtgcatgtagcaaactgtgactgttcatttccttttaattgcatagaataactctttaataaatgtatactttaacccattcatcaaataaattttaggtgaaattattttaactaattctcatatgcactcctagaccctggagagccatagaacttgaagatataaagattagactgagagtatattgaaaagctaattttcaatactggtgatactggtagatttgcttacaggaataactacattaattcatactgccacactgctatttttgtagaatctacttttatcatccagttaatcccagaaaataacaaaaatagatatgtatttaaagagcagaaatagtagttgtccaagtatagacaagctatcttccttttagtgaaatgagcctaatatgctacaataattccaggacttgagaaaattaacagtggatgtgcttttatctttactaaagatggtttttctgatatttctgattcctggtaacaatgccttttgagggtatgatagaaattaaaacaaacaaaaaagtagctcaaatattttctctatttttattctaaacatcctattggaatttagtacacttaaatgtgatggatttgagatttatgaaaaaaactttgatactgattaaacttttttttaaatattctttttttggaattttttttaatccttaaggaataaaatggcacatgtttattacttatatctacagagtcatcaacattttaaagtacattttgagaaggtatctgtcattagagaactatagtttaaaatactaagtacagttttaagacatcttgaaaaacataaccagccatagacttagagaaatgtgataataccatgatagctggctgctattaagttgacattattgtggctttttttttatttttgcagatttgaagtacttaattttattcatctaccatgaatttttggtactttaagtatgacatgcatcccagtagatcccaattgcaaaacagaccctccctttttacttttttttataggagccatttgcctccagatgaaaagactatgtaaaggaaataagtgagattatcattagcttctaagggagtaaaagttttcccttagtaattttatgatcacagctaggatgatttcctcttgcaacataaaggtgcccactgtcttctttattatgacaaaagtctttttttatataaaagtaacaacattatgcaaaaaacggggatttttgcttctgaatgtcctcaggaaatagaaaaatgtgataagctgagacttgagactaatacaagaaactcctgtatttgcaaatccatcatgacctgttttttagaaacacacactgcatcagaaggtatagcactgttcttagtttatatgtaccttggattcaataattagaaaacaaaatatataacttggttaatctagatgataggaatcagtttgcaaatactgtaaaactattttaaaagactgccttttcagggataagagcaaccatgcagaactgcaaataaaaggatgactaataaagaggtatctccaggaagggatttttaaaggtaggagagctacaaaggattagaatacgtggaattctaaaaatttaatatggtctatttgggattgtaaagagaaaaataagatagctatgttcataatttaagtgcaatgtcaatgaagacacttttaaatagacttgagttaaaataatcagtatccagaaaataaaactaaaaattatcagtaattactggattcattcttgtccataatcactttatttggtggcaaggtgtggggggctgctactttcttacaactagaagctgagcaatgtatttgaaagaactcttacctaaagcatggtcagtgtagaagaataaaataaggaaaaaaggataaaagtcagaaaaaatgggaagatgtgaaagaaaaaagttaaaaaaaaaaggaaagcaaaagaggatagaaaataaagagagaacagaggggagggagaggaattgaggaagtgaagaagagcaaaacagaggaaatgaaaaatgagaggaattaatctcatgagcctggggagactcaagtgtcccttgatcaatttatatggctcttttagttttaaatcaggacgaaaccaaaattttcccaggaaattcattttcccaagttttctcctctttgcccgtattataataaatgaaggaagcctggatgttctccagcttcctaaaaaattaaataatgctcctgctgtactgcacccatctgcgtgaaatttcagtcactttcatattggcttcccctgcactttgggcataggacaaaaataatccataaacagagatttgaagctgaattttgaaggaagataatcaggcttttatggatacttaatactcttccagtgatatgtttctcctcccttttgccccaccatatatacaggctacactttatttacaataagccaaaatcccaggtgagccacactgatgtacagtttatcactaagaggtgatgccaccaagctaagggttttttcttcttctgtacatatgctcatttccacatatctaacttacaaaagatgtattattctataaacacattcatttcacttcttggaaaacaaattagggcagatacttctttaactagaacacaaacatgctatagctgaaggaatgaggtcttgagtcacattttgaatttccgaagaaagaccttttcatcctctctctccctgttaatggtagttcctggaaatattgttataatatctgaatcagtcttcaacttaatatcagtgtatactaacttggatgataaatgcccatcaaaagttttgtcctcaaaccacatagataaagacagcaaaggaaacagagatgattgtgtattcctaaaacgacaaatcctgagagaagagtggagaggcagatgatagagaagtaagattgtaggtagagaatggcctacctttatccctgctacacatttaacagatatttagttaacattttctttttcctgtaaatgttgtagatttggatttttttggttttgggggttttgttttgttttcatttatagagtttctttgacagcgtcaattagaagagcgttagtaactggagctgtctctgaatgtattttaacagtaacatattattttacaaatcatttatgcctcagagcagactttctccttaccatcatattttttcctaatcttgaattatttatgccaatataaaacctttaagactaacctttagcctaattgttgcaagagatctcagctttaagatgtaagaattcccaactcctaatgcaaggcagctgggttggaaattccctgcagttggcaagatgctgttggcttcttagggaattggcttgggtcttgggttccatttctttatgtaaaagtaagaaaaaatggaaaactaagagtgctctaaaaagatcaaagtattttttgtgcaactttgtaaaatttaggtgactcgaggatagggaaagcagcacagtttaattcttttaaaattcaactttgagctgtcccgggatgataaaatgcctgatattcatgtgatcttttgattttttaatatcccttgtaacattgagatcagagagaaacattttgttcatgttcaactaatgtcaaaatatctattttgtatttatattaagaaaacaaaatttcaaaaaataggacaagataatttcagtcacaaagtgatagcattagataaaataatctacattactgacgatttccaaataaaattaaaagatggttaggtttatccaatctcttgttgttgtttttgctgtgtttactttactagagaatagcctttagtattatgttttgaaattctactctggaatccttccttttgaatttgctgtcgttttctctgtggcttttaatgcaaggtatggagcagatgctcagactttggcaaaatgcaatacatttccacagaaatactgtacctagacatttcataattcaacaaattatagagaaaaggtagttaccaaaaccccaagaagaattgttaaaatgaacagagaataccttttaacatttactggctgaggtctaccatcagctcatgaagccacattgtctgatgaatttaactgagctacccaaaggaatgttctagcgtgtttagacaacttgctactttcatcttttctgtggtatataaactatctacctgatcagtgccaatattttcctgagataaaatgaaactactgccatgtttgtctttctgtgcctgccttatttcactcagcataatcacctccagttgcatccatgtcacatgttctcacttattagtggaaattaaaaatcagagaaattaaacccatggagacagagagtagaaggatggttatcaggcagggtagggtaatggggggagggaggtggggatggttaatgggtacaaaagaaagtacaaaaaagtaggaaaaatgactaagacctagtatttaatagcacaacagggtgactataatcaataacaatgtaactggacattttaaaataactaaaagagtataattggattgtttttaacatgaagaataaatgcttgaggtgatggatatcctgttttctatgatgtgattatgatgcattgcatgcttgtatcaaaacatctcatgtaccacatagatatatacacctattaggtatccacaaaaaattagaaatgaaacatttacaaaaaagtaaccactgcaactatgtccaagttataaggtgcacagtattagtaaacagccattttttgtgcagctactcttgacctttttatatagtttcaatttcctgtgttgattccagatccaatgtgggattttaacaaaatgttgtctatagatcattccttttttttctggcagaatcagaattctgtacttgaaaaataacgtagtgttcctgagatgagaatctcatttgctatacgtcacagaatgccatttttggaaaacttaagagaaagcaaggccctaagtattggcatatttctgtaagattgttaatagtattattctcgtataacaaaatgctaccctgtgaatgtgaaatagggtgcctgagagttatcacagtttgtacaattttgatcaagacttatactgattactcactgcatgcttgtatccaaacatctcaggtactccgtaaatgcatacacctactatgttctcacaacaattaaaaattataaaaatttaaaaaagacttctactgaccaaaagaaacccattgctccaacagcaaaatatacatttttttctaaagattagccctatgtccatagaaactgctcatattacagcatatggaggtaatttatcagtggaaataagataaatagctcctgcaataatatcgacctttcttcctaggacatgcttgtatcatctgagttcttggaatcccaaaacactgaagaatcagggactggtcaaacgccttgaaacttgggtgtctacccccatatctagacttagtagctgaatacagccaaaactaagtagctctacatatcatctaggggatagtttcctgtttttctgaggcattaattgaatggagatgaaggacaggggacaaaaatgttgctccaatcaatcaggtcagcagggagctggaacattgctttatccaggagtatacattgatgtttatgtaggagcccaggatattttcagtttccaaacaggaccattttaaagtagggttttcagatacattttattataatgactaatattagtccatttagtctccatgtggtgcctacctctgtgaatcaatagacacaaaatagcttaaataaggcaatagacctccatcatcagttatgaacccatggaactgttactctgagttcctcagcagacagcatttccggggaaaatatggccaataccatattaaacaaatggttgtgataggattactaacaaaataccacctacaattctttcttattcattccctcctccattttttttattacagtcactcttgcatttcactattcacacagcatcagctatcttcttagactgcaagttacatcatttcatttcattacccaaaggcttcctactgcatcaaaataaaggtcaactgctagctgaaatgcacagggctcttcagatatggtcccacctacctctagattgtcatcttgtgccatgatcttcagcatcaccaggatccagatatactgcactttctgtttcttaaacataacacatttaacacatttattttcacctcagatcctttgcctccttcttttttttaatttttttcctctccttaatgtatttccctggatcttactaaatttttcccatctttaaagtctcatttcaagttttatctcttcaaatgacattttttcagagcatttataatctgaatttaattagcagaatgtgtatatatgtgtttttgcataactctgtaggtactcacatctctatccatcccctaatcgacctaaaatatgtttttcctaaagtaagtatgtggtttgctacagaggaacagaagcatttacagttttactcatcattgtattactgttacctagaagagtgcctaagtggcacatagaaaatgtttaataaacatttattactaaattaatgtacgcaatagatgcctctcaaagtgttttggcaccacagtgttatttgaacatcactccaatgctatgtagtcatttgagcaggtattatttcttcatccaaaatgtaagaatagagactcagagagattaaagtattgcacctaaaatcacatagcttgttctcgagaaaaatcagtttaaatctgagtatttagatgcttaatctattgtgcttactacttattttactactctgcttttctcatttttgcctccagtactaatctcatctttttgaattatcgcttcaaaacatatgttatttcaaaacttatcagcaagatatcaatattgtagaaaattcccaggaaaaacagatacctgttgtctgggagttaggggatgtaatatatagtatttgtgtatatatatatatacacatatacagtgtgtatatgtaaaagtgaggatgtggtttgaggaaaatgattaagtttatatttgaatagaaagtggatgtgttagactattcttgaattgctatagagaaataactgagacgggtaatttataaagaaaacacgatttattggctcagtattctgcaggctgtacaagcatgacactggcatctgcttggcttttgatgagggcctcaggaatttccaatcatggtggaaggtgaaaggggagcagatgtatcacatggcaaaagcagaagtgagagagagagccacacacttttaaatgaccagatctcaggtgaactcagagatagagagctcaattatcaccaaggagatggcccaagccattcatggggatccacccccaaaatccaaacacttcccaccaggccccagctccaaaattgggaattaaaggtgcacatgagatttgggcggggacaaatatccaaaccatatgagtggatttatgtggatggtggcattccaggaaaggaaattttacttgttttcatgtctttctgagttttttaaacttatattttgaagcttttttttttctaacaacataatgtattatatagttatatacgcctcaagcgtaccctacagcttttgaaatatcttagagtagcagccccaaataatttggggaaacatgggtaaacaagtttgaccatatttatttaagacatgatttctcagagacattaggatgttaatgttttcaacagtgttagaaaattagcagagttttccagccacagaaacttccccccttgctgccccgccactggacacttgccaagagctgatgacaaatcaaatgaaagaatttcttgggtatgtggcaaaggagatatattagagaggaaagtataaggaggggtttattttcattgtcataagctatgttctcattttgagcttttaaaagggtaaactgcagataattcctacatcaaggggctcatttaagcagtttgaagtaaattaatttttttttcttttattattatactttaagttttagggtacatgtgcgcattgtgcaggttagttacatatgtatacatgtgccacgctggtgcgctgcacccactaactcatcatctagcattaggtatatctcccaatgctatccctccaaaaatattgtattgttattgaagggaatatctctgattcaaaattatttttttagctgacttacacattatgtgtagggtataacatgaccttctagggataaatttatactgacagtcttaactcttcacaagtaaattgctaagggaaaagggccagctcttgatttctaaaggaaatgatcattttataaattcaaaggaatttataaaaggtgaatcaccttttttatgttatatgccagagatgcaaataccctggcatataaatatttgtacatggctagaaagatcctccaggtgtttaagatactcttgggaaatatatagtgtactttagcaagacttattaactctttaaggactcaagagtacattttataaatgtttgttttcttgcattaaatcataactgagttatccaaattattcccggggaaaaatataaattaaaaataatttaaaaagtaaataaaataaaataaaataaaataaatataaaaaataaaaaagtaaatgaactgttaaagatactgcactgcatttttcagagctagagatgaaaattataaagtcatatttttcgttttcacccctcaacaaattgttccttttctgaaagcattgtttttctatttcttggagaatggcagtatttctctggaaatgtctgtgttcagttattatagcactataattaatatgctttattggttgatgtatgtgccatcagagaacaatataataaaatcacatggaatgtgaaacagaatatattaagtgaactttttctgtgccataatatgttcttctcatcctgaaaattgaagagacttatatgggatgtcatattttccccagggaataattggataactcagttatgatttagtgcaagaaagcaaacatttataaaacatactcttgagtccttacagagttaataacgcttgctaaagtacactatctatttcccaagaggagcctaaatacctggaggatctgtctagccatgtaaaaatacttaagcttaagctataccaacatgttaatgtattttcattacaatgtgaagcagtttagtatcatttaggcaagtatgtccactcttgaagaattcattaggcagcagctgagttttccataaagtctgcctcccaaagtggcatatttaggcttcattctccatagaaaatattaactgtgaaattttatgtgtaagcagtaaattatcaggactacacagtggaccaattttagaaatagctaatcaaagacaatcaatttcccatttgggtgtcagtatgtggtggtgagatctaataaggacggttgacagacactcactcgcccaatttcctgcttcaacagagcgtgtaaccgaagtgaagactgatatcttcgtcaccagtttcggacccgtttcagaccatgatatggtaagtggacactttatctttgcttttcttgaagaatttttaaaatttaacttttcaaagaaaaatataaactaagttcttagggagcaacctgaaaagtcttggctatacttttgtgtctttctgtgtgtaatatgtaatatgtaatataatatttatacaatagaaaaatactcatttgcattccagatcagacctatttccatgattttcaaccactgcagtcatctttttttaaaaaatattttaaatgattggtttgccttggttaataccccacaagccatacagtatgagttatgtttcattttagttagcaggccatgttgattcaaggatgctgttttcaggcaaccagaactgttatagaatggccataaacattatgatttctaaattatttttggctactaaaaactaaaaggaaatgagtgtaaaagttggccagaattagacaaaaatacttaaaacacaccaccaggaaacattctgcttcattgcaaaaagcattcattaaagtattatccagagtggaaatacaatgaatctatacctgctctttttttctagttcaaataaattaacatgaatttctcttctgtctgatgggagttatagagctctacagaaattatataatattcctgaactaataacagccaaggttctatataagcaaaacatcataaagtggtcatggaaacataccattatgaatatttcaaagatacattaattgaatactatttttgaaatgcctcatgttagcaccagcttactgtaaaagtattttgatttcaaaatagctcacagagggtcagaataaaacttacagaaactatgaatggcagagtaaaagccctgacaagttctgaggtaaaacaaacaaaactatattttatctggtgttttcacaattgtatttgcccaagaccttttttgtcatttgacccctgtttatattctgtagaactaatattctgtgaagtgaacgttgggaaattctggccaagaggataatcagatattttagattttaagacaagttttgaaatatgccaactggacaaagaaaaatatgtggagtatataagaggtaacagagtggtaactaagaatgcagatttctgaaccagattgcctggtttataatgccagctacttcacatagaagggtatatccttagggaagttacttaatatctctccagatcagtttcttcatgtataaggtgggattaataatgccacttaacaaattttagccattactaatatgcaagaaatataatatgaaagtcaatcatacttgtgaatgtatgcatcttacgatttattttgtaattatggtcagtctgtagaccactttattgaaataacatgtgatacaatgtgttttactaaattgacaactctctgaggactcatgattctctcatgttggaactcagtcttcccacactattctctcatggtacttttatagttaagaatgcttattaggtcccagtcatgtttaaggtcaaataaaaactgttctgcctgtattcccataaatgattttgccactctctgtcacttgttcccaatattaactatttgttttagtcctgctttctgcaaggcagtacagtgtgggggttagcagggctggctctgggattcaagctggttgaatccaaatctcaccatcagcagcagcatgaccttgaacaaattgcttaagcttctaaggctcaaagtctttcaaatgtatatattattatagttgcctattccttcaacatttttataagttttaaatgagatgtgcaaataaagtgtctatcaatagtgctcaataaatgatagctattattatttttacctctgagctccttatcatgccatgcagacctcatggaaatttcttctactctttacccatctaaatcaaatacttccgcagaggcccaaatcaagacccaaacgctttatgaaatcatttttattagtccaataaaaaattgactttccgtttttgtattctaatcacatgtattgactataaaataccttttagctttcggccacatatatagcactgctttgtaaacttatttctcttatttataaataaatatcttattttcttaaattgttgccaaacctgtaaaggcacatgtgtttcacatctttcacagtattagttcattgttattttagagtaaatgttaaattactcttttcttggtgataggtttaggagcctataatattaaaaaaaaaatgaggtcttgtgggacctaataagttatgccctctttcttatctgtgttctgaaactttgagatataagacaatagggtagaaggcatggggaattaaaatgtcatatatattgctaataatgatgatattacagaatgtgacttatatctgtagacaagtagatttgcagagattaggcaccagaatcaaccagattaacccacccagtcataggcagtgttgactttcctttgctggggtgtacattatgcatgtaaaacctccagcatggaagagcacaggagaatttttcactcttataggcagccagcagccaaatggaaaagacaagagaaaaggactgaaataggtaaaattgatgttttttttccaaattaacctatcagattaaatccccttccttccttcttttttccccagtagaagaattggggaattgggagcatacagaaatttcctttttctcattgatgaaaacatcaagagagggcatgcaacattcaaaaacatcacacactgatggcaatactcatcttactacttataataatgtaaaatttgcttaatggccattctatctcagtctctggcacctggcatggtgctcacagagtcaatgtccaataggagttgttaaaggacaatgcccaaatgaagccacaggcgatcaaaagcctttctcttttcttaaaaaataggtgacatgcctttgagttattgcttcagattaattgtgattccataaaccaatgttggagtttttaaatcttagaataggctttttgatacaccttcaaacctgtgattataatctacattttatattttacatttggtcaaatatcaggaataaggaacagcgtgtccaaccaacaatattccctattgcctaaaacctctgaacaagacaatgtttcaattgctctgtcaaatgatcagattagccataggtctgccactggtttgctagtagctggtagaaattgtatctgaccaccttgctttagaagattaatcatttaaattacattataggagaattgtgtacaagaagaagcagcatgatttagaagcaatcaaaattagaaggcagaaagacaaagctatttttcaaaatgggaaaattttgtagtttttaaagtgagaactaataaattaatctacgttaataacataacaagatttaatgctattgaatgcttacaacacattaggcaccatgctaaatgctttctagaaatttcatctaatccttgtgcaaaccttttagctaagtattattcttgtctacatttcctggagaaggaaagtgacctgctagctaagtgtagcaacttgaacccaggttatttagccctagagactccatagctcccaaggcatctgacttcatctggaatagcaaacaaaattaggacaattctctaactttattttaaaaaccattaattggcaatcaaacagaacattcccagggcactaggttctgacagaaatatccaggcagtacaatcacagagccttgttttccatagtgcttaaaatgtattaagtcaaaatacacacagatggtaataaatggcacaggcaggaacacttcaatacaatatttatttaggaacatagcggatgttttgtcccagatcttcagactaagactcacattctccagggacctacactattgaacagagcaactcatacttttcacttgagtggtgggggctggagcctggaaacttgagcaaattatttaggagaggtttacctttgtccaacctctcttccacggagtcccctcttctgcattttgtttttagttaacttggtttcggccaccttcttactttccttagatttcctttcctacaatccttctaaagagaaacacattttcatgaccagctacataaaaacctaatataaatttgtgttgataaaataataaaatgggagacagataataatttctaacttttactaacagcttcctatgttctaggcactcttaaaagatattctcacaagtctcaactcacttctcacgattgcagggtgaattatcccattttatagattaagaaactggggacttagcaagcgtaaaataattacctaaggccactcagcaggtaggttcagaacttacatccatagtcattatgctatagttctgctgctcgcctctctctttttctagcttccttaagaaggggctttggccaggcacagtggatcactcctataatcccagcactttgggaggccgaggcgggcggatcacctgaggtcaggagtttgagaccagcctgaccaacatggcgaaaccccatctctgctaaaaatacaaaattagccaggcctggtggcgcatgcctgtaaatcccagctactcgggaggctgagactgagccaggagaatagcttgactcaggaggtggaggttgcagtgagctatgaccgcgttattgcagtccagcctgggcaacaaagagtgaaactccttcagaaaaaaaaaaaaaggaaaaagaaaaaaagaaagaaagaaaggaagaaagaaagacagacagacagaaagaaagaaagaaagaaaaagaaagaaaaaacagaaaaagagggggttctggctaatcttcatccagaagcccactcttggtctaatgaactgtgcccatggggcaaggtcatcttataggactagcttctgggaactacctgctgctaccacagcaatcacacagggagagttctcagaaatgggagaccaaatatttacactgttggttaggcagaaactaattttcatcaactgcttttatttcattttgtatttcaacttctaacagtgcagaaaatggaaatgaagattaaccagcgagtgttgctctgtgtgtgtgtgtgtgtgtgtgtgtgtgtgtgtgtgtgtgtgtgtgtgtgactggtacagtatttgaaggaagaatgtcctaaatgaatttggggattccattgtctgtcattagcacaaataaagctggtgacaaacacaataaacatgtgaacatcaggatgttggcaagtcttgacataattttttgaaattattgcctttgggatacatcttgtcaaagatttggtaatacatctagtttcagtttagtttatacttaacatttattttattttcataaaacctctttggagcaagcaaataaaatgaaccaaaggctcgattcatgggaacgtggtcaccttcagcatccttggaactttgatttgcaggtggccattcattccttctgctgttgaccaatctaaagtcattcagttggacagaaactagagcttatatggctaagacctgagtaacagaaaatttcgtcacatattatatccctacctcacaagcttgtctgtcatccagagaggaaaacctgcacatcctgaggtagatccatccacccagttttcctgacaggcattggcacattgtatcacttgctgatatcatccacagtctcccttcccatggaaaatactattctatgcccatcgtacaccttcatgagtttttcttacagtgcccaagcttaaacagtccctcctttgctgaatttattaggtgcttaagagatatttgttggtgagtaaattccctttatgtatctatcacagtgcctttcatctgacacttccagacacaaaatcctaaccaggaaacaaggtaacttgtcttgtctacaaagacagtctgtcaccggattacacctccttgtttctatctcagtaagcaattagtactatatctggtgcattataatacatttaataataattgttagttacttgatcagtaagggctcagtaatgccaaacatgtgccagagaacacaccttcattcagccttcacccagtattgcttaagcccttggaaggagacatgtagttaagttcgtacacgaaactcctaaacacatacattttattttgtaggtcctaataacgatatgtttaacatttaaaaaacacaactgccttgtgatgtaaaagggcttaaaggattaggaaaatgtagtatgatgttttcaagttagttctctttctggtttggagtatacttagattaacggagaatgtggtaatctctatttcaaaccattgagctccaaatttagtgccagtgtggcaaatactgcaagaaagatggatattacccttttcaattttaggagctggtaagtcacattgcttgttttcagattagcagatgtttgtctctgggtattgccataaggaatgctgtgtttattcaaataaatagattccctggctgtgaatgatgatgagcttcaaacatttctcatgtggcttatacacatgtacaatcacaaacacatactcacacacaccgacatactctgcattcttatttttgttctttttctttttgaaaaggattcaaattaccagtagaagcagtttctttgttttcacaatcttctttaatgtgtaggataattgaaagtctatatacattatctgtgaaaaaaatgtttatttcgccaaaaaaagatggaatttttacatccatattggaatcacaatttacttgggtgtgggcatgaggttttcagagacaatgagagggcccccaaaacactaggctttatctttatggctggaattgtctaatttaaacatttttttcctgtgcataataccctctaacatgagtttgttttaaaattgtgatatattctatttcttctagtgctgctgtgatagggtggaggtggggtgttactttccttttacatatctgagcagataattggaaaaatttttctgaccaaaaaatatgtcaggcattttagatattttttttaaaaaatcattacaccaaccagtgattctcctgacatcaacatgtacatgctatcacacgtttacttctaaaaacatcacctagctaacattatacttccaaagttgcaaaaattatgcactgtctgcgttagatatttgcattgcaaaatacagcacagtgaactcttcgtcattttccaaaattacctaggaatatacaatagatgtatttttccgtcaaagctggaaggatgaaaggttaaaatttaaaggacctatgacagtcctccggttaaataacctaatggcaagtaaaatctggactccggacacatttttccacaatggaaagaagtcagtggcccacaacatgaccatgcccaacaaactcctgcggatcacagaggatggcaccttgctgtacaccatgaggtaaggatggctgcactgccattcatgaatgtttctgtacttcattcccttccacttgtaggcaatcatcaggctgatgagccatggtggaatatttgcttccttgtttttcaaccttaacaatcttaaaaatctctccaacctgttctaattccctcagtcaaggatgaagtattatttatgcaaatgtttatttgcttacatctagttttattcttaaataattttctgtagctaggtggattcaatataaggaacttcctctccctactataaaactcatatattccttcattccagtaagacctaaatttctagaagccatctaatgatctacatctgaaaacattcctactaaaaatgaagtaataaaaaacaaaaaatatggaaagttacaaaattcataaaacacagattcatgtagacataggtattttaagaagtatttgaattcacaatggcgttgatagctagacgagaatatagatactattaattttgctcaaactaaagactacgtatacatttctgttttataaacatttccctctctttaagattgctgtaaagcttagcatctattaagtgttgaataccttatgactgaatgaaggaaacatgaatcaaataaagttttgaattttatatagaaaaaaagagatgtttaaaagtattcctcatttatgagaaattaagaattgtctggaactcattcttgagagcagcagtaatttattcccagatgacttgttagatacgagttttttacatttggtcaatacacagtaattcagatttttcaattatttctttggtacaaaaaggtaataaaggtaaaatcctaaatttatggattgtatgcaagtacagtaatattttgcctttggagaaagctgccagaatgcctagcttttcaaatgcaaacatccaaaagaaaagaaaagaaaaaattcttcaagagacactttggatattgagccaactaattaaaatgtattaggacttaaaaaaatctaaaagatagaaatagaggaccaatggacacatgtgttgagaactttctagattatctaagcaggacctattcgtaattgaaatttgaaatattcccccctgatgaaacaccatacacttggctttgagcctaaatccagtactcattcctcttagatggcaattttctgaggagagacttgcatatcctaagtggtttattgattaatggtttctgatgtatacagtgttcttcatctgtatctttcatctcctaaaattttcctttgctaatgtgtttttactttctttaataatttaatttaagaatgcaatttaatcataaatttatactttgtatatttgctttagttggtattctaatcatttaatgattgactataaatctatcttactacgtttcttgagctacttaataatatgggtaaatatgcttgctaaaaatcatatgaaggacatgaatatcaatttccttataattctacaaactgaaagcaaatatatttcagtgaacttctttcttagcaatccaaaaaaaaacaaaacaaaacaagaatagatttcacatccacagaacatcccagggactagagagaagcacagcagagtcctagcttcaattagatggtgggtttgtaaataaaacgaaatggtttgcaagtagtgagatcatgtatggagatgttgtattaatcttaatctcacaaagcctgaggacacatcccccttcagcttttcctaccttcttctatgcatttggtgctattttagagaaagaagcagagagagatgcacttagaacaggagaaattctcttctcttccatgctatccatgtcttcctctcaagcaaggataaagtagtatttacgcaagtgtttatttgcttacatctagtgttattctcaaaccatttgctatagctgagtggattaattaatggtcgttttggaaaatattaacaaggcttgcccattgtacaatatcaggggttgccttgtttcttaaagcaaacaaacaaaaggatagaatccactcattattgtaaatatgtatttttagatcatttgattattaacagctcagcataaccctgcaattatgccttctttgttaatatatttgctacagttaataacattccacttgtacttatcaagaagtatctaatctatatggctcttgtttgtattctatgtttcccttaaggctgacagtgagagctgaatgtccgatgcatttggaggacttccctatggatgcccatgcttgcccactaaaatttggaagttgtgagtaaatttatatggacttttcttgattgtaagtcattaagcaagagatctctagctatatctgtgagaaaaacgcgtagataagggaatcaagaaaatttaaacagcaatataccacatggactttccataagtagtgctctgtgacttcactttttaatgttgcttcaagagagagcttattctttatctactgaactagaaagcatggattaaactagttattgaaataattctatttatgctgaatttgtatttatagaaaaagaagtgaagtatggatgcttctacctcatggataatattttcctctcaattaatggagatcattgtgtctattttatatctttactgacacttgtttgatcttaaaaataattaaattcgtttaccagattaaagtgttggtaaatggcaaaggacagtaagtgtttcttaataatgaagcctacaccaaactgatgttgcaaaaaacacaaataccctaatcatagtcttagaaaattagctgatatgtgtgtgtatctcatggcattcatatatatatatatatattagtgctcttgaaagtatcctggataaatgcccttcataataacttcctgggtttcagctgtttgaaaatattcagaaacaccttggagcagccaagagaaaaatgactgtgagagtcaggttctccggtcttttctttacccttctgctttcaactggtttacatgcatggagtgagtgggaataatgtattcttggtttcctgcaggggagttatgtacaaggactgagtcaactcctggactacctaaccgattttctgttctcactagacaggcagtctaaatgactattttggtgaagatatgattcatagaaaaataacagtggtagtgtaggaagacagaaagtaaagaaaatagcaaaaggccttcgggctcctagcagcatcagtcctggagagagaattttatttataaatcccattttgtactgaaactcgaagataaactgcttcaaaaactctaggttaaacagacatttggtgataactcccttctccctgcttttttcccaatttaatatacattccttaatatgaacgattatgttttctcctgaataacagatccatttgtaataatgacaatatgtgctacatgttacttgcatgtcagatagtacattaaatatttgtatatttataagttcatctaaatcacaacctaatcttacagttaggaagatcatacgccgtagtttgcctgggacagtatcggtttatgcctaatatactggtatactttttttaagagacaaggtcttgctctgttgccatggctggagtccagtggcacaatcatggctcactgcaggcttgaccccctgggctcaggcaattgttctgctttaggcttttgagtacccaggactacatacatgtgccaccacgcctggctgatttgtaacttttttgtatggttgtggtatagacagggtctagctatgttgcccagtctgtctcacactcctggtctcaagtaaaccttccaccttggcctccctaatttttgggattacaggcataagccacagtgcccagcctggtataaatactaataattcccccttttatcttaaaaaatcctaatttggaaaatgaactgcatatttttaaaaattagtcaggaatgctttcagcagtgagaatagctgaaaaaaggagagtttatcattttatataagatgtgtgaaagtgagtgctgatagatttctgattggttcagcatcctaacaaggccactgtcttaagatgtctttagatattctttctcatcacaagatggctgctgtaactccagtcaatgcaattctgtttgtgatagaaggtaatagttggtaaaaatgaaaggagtaatgcctatacgaaaaagataaaagctttccctaaaatcctagtggaaatctacttacatctcattaatcaaatgtctcacattgccaatgatatttgcaaagaaggctggaagtaaatatttttaattggacacattgtcaacctgaagaatattagaggtattttaagaagaggtaaatgtatagtgagtagaaaacagtgtctcatataagaaaattgaagctaaagaaaaataagtaagctgttttccacctcagagccatatgctcttttctttgcttggattactcttcccttggttcttagcatggctgacttctatctctccacatgtcagcataaatgtcatctcccagggccttccctgatgaccttatcgaaatttgcttacagtctcaccagtcttgttgatcacaatgcacatttattttataccatttatcacagcaatgatgattcattttatttattggttaacttttgtattgcctggagactgtaacgtcacgagagaaggacatactttgttcagcttttcctagcacaaaggcaaatacactgtaggttctcagtaaatatttattgaatggataaaggttacaagactcaggctttaaatgccccttcactgtttaagcttcagaaaagagagtgtaagacctgtggggaatgaaacagagcagactagacattgaagtgcaggctttgacggtcatgcttagcggaaaagaacaccatggctaattaccactgcctggcattggcacaagaagaggcaggggcagtccatttgttgtccagtcatttctctgacctggcctacttagcatatttcaaaggtgaagaaactgaggcaagaatgggctaaaaatattttgactcatttttcgaagtaaacaccttgccgaaatatcagagaaaagaatagacaagaggagttttcaataatttagtggaacagtctgtaataaatgtttatgaatattctgaagcaaccttatccatatggtgataaaatctaaagttgagaagcagtctttcttaccgttctctattagattctgattgttaaggctaacttaaactttctactggttatggataaagctctctttataaagtcagctaacccgagggcaatgtgcatgatacaactgtgatcgtttcactgcttttgagaaatataccaaataaggctttgtttccaaaagaagagatttgggttgcagattctgacataaagacctaggcaaaagctgaatctattaaggccttaatatatgattgtcttttggctaattatcaaaaaacaatgcattgcaaacacactgagaggaatgagtcaaaatttgaatgaattctgaacaatgtacgactttagaaatcattttgttcatgtggctcatacaaatggaaacacagagactcataaaagtgaaatgatagtgtcaattagcaactctcctgatactaagtaatatatgttcccagtgttttaccaccacagagttctttcataacaccaaccaaaaccttcttgtcttttttattttattaattaatgtttttgagacagggtctctctctgttgcccaggctggagtgcagtggcacaatcagggctcactgctggctcaaccttttgggctcaagtggtcctcgtacctcagcctcctgagtagctgggactacaggcacatgccatcacacctggctaattttcaaataaatttttgtagagacagaattttgccattttgcccacactggtctcaaacccctgggctctatagatctgcccatgttggccttaaaaaatcctgtgactgcagaaataagccaccgtgcccagccaccttgtggtcttatttctaaaacttttttgggggcattataatttatttgaaattgtaacttaaaatttttggctaagtagctgaagactctttttaatctcacttttcttatgctgatgtctctggtcaagtacattttcataggaactattttctggttactaaaatttaaggaaacaataggatatatcatctttgctaaggccttaagtatatctgtattctccatcttaaaatactaacttgcatcaggtgaatctacccttcattttggaagattctcatggagagacatggataatgagtcatctgcaccttcacaatgatgtcatgtttgtagtagatggcctatacattttcatatgcaatggtgcttctatgaaattgcaagaaatgagacaccaaaattatataaaatgaaaagtcaatggtaacacatttttccccctctacaactatattagcagctccgtaacaacacatgacaaagtataaaaagatagggtgcagacacttttgctaacagcagtgcaatataaaagcaagagttttagtttgttgtgaaatgacacaagatctagacttggtttcatcactaattgcacaaccaccaaatatctttgcttggcttatgcaaacctatctaatatacagttttgcctagaaaaacacttacaaaacacagtaaagtcaaatgaacggcatcctaagtctttatcttggttttcccagttattagtaatgtctgcttaaacaagtcatttatttttttccctcagtttaccatccgtaaaatgcaattaaactctatgacttttgaggcatttgcaaattgaacattcaatcattccatgttaccataaactcattatgtcttcttaggtaagatgcttccattaaaaaacaataatttatcatattaaaatattagtaaatgtggttatctacaaattgtaaacgatagggtccttctcaaactagtgtgctctgccttcttctaagagatttgtaaatcacattttacatccctcctaatagacacagtactgctatacacaatggtgaaatgctttcatttttaagaccatgaggataaccacaattaaaaaggaaaaacaaagataaattcaaaattatccatttcgtacttttacatgtcccatgaaccactaaatttttagttcattctcttaaacttatggaaaattttgtttttaaaaaccatctgattataaattgatgcagaagtgatattggaactggcaggctacccttataaaatcagggaacactggctacatttttctgcatcactcacctcagtgaaaagtaatcacattagaagctttgttttagggactgaaaggcatggctcacatcttttttcagacagccttattttcatgtaaaaaagcaactatagttttacacctcactatatcttatctggggaaaatgtgtattggacagaacacaaaagcctggttatttaagtggggattgggtcaaacagaggtgcattatgacttttatgagccctaggcacttttgcctttggaggccattcctccaagaagaaaattaaaattatttcatgaccaggttgctacaaagatgaatataatccagattatattatattcactttatctttggatttcaaaagaaattaaaatatttttgtggcctcctaaaagtattgagggcctcaggccctgtgcctaatggagaagttgactgttggccaatgagtcaagctcttgtcataggccaacatttactatgatgcctccccctcaaaaacactggaaacagcttgctttttctaaagtgatattttctttaatgtttaacctcattctgcatctaaatagaagagagtacgtactatcattccaacctatgtgaagtgggtgttataggactagaaatcagaaaaggtatggaattccttttccttctctttctctctcactctatgcaatctctccctctaaactgtgtaaattatccatcagaattatgacctaacctcttattaggagatggccaagttcaaagtgacatggcaaataaaaatgattgagaagagtgatagaatgtaactcatcatcatggaaaatatctataagaaggataatcagtagaaaagaggagagtaaactcagacttgctaatggacatgcagcaaaatttccagtgatttttacatttatcatgaccttcgcatttaacatgaccttttcctggcttaacaataatttggaccaaagctactgcctctaacctcatttcatctctcatatgcttcactctagtcaaactggtcttcctcaaactagtcaagcttttgcctgcaatagaagaaaacacttgggaggctgagacaggaggattacttgaacccgggaggcggaaattgcagtgagttgagatggtgccactgcactccagcctgggtgacaagagtgaaactgcatcaaaaaaagaaaaaaaaaaaagaagaagaagaagtagaaggagaaggagaaggagaaggaggggcagggggagggggaggaggaggaggaggagaaggagaaggagaaggagaagaagaagaagacacttgttagtttgtctattggacaaactcttccccaagattttcacatgcatctgccatgtatttgtataaatgttacctcctcagagacgactctgtctgagccccttaccttacttaggataagtctccatcccttcattctctatccttttactcggttgtgtatgactctatcacacttatctctacttgaaattacatacgtatttgcttatatgtttttgtccccactgctacaatgcatattccataagataaagaacatttgttcttatattcactactgtatccccagcacagtattttgtcctttgtagatccttataaccatttgttggaagagtgaataaatgactaaaaaaaaaaaatcagaaaacgtgttttagtttttgtaaattaagggacataagctcatctttcctagcctgccctctggaaccatgatatagaaaatatgaagctgatgaaaggtaccaactaaataagagaattgaagtggtaaaatatatggatcattttctactgtttccttttagatgcttatacaagagcagaagttgtttatgaatggaccagagagccagcacgctcagtggttgtagcagaagatggatcacgtctaaaccagtatgaccttcttggacaaacagtagactctggaattgtccagtcaagtacaggtaagtacgattttgttacttcagttatggaggaagaagaagaataatattttgtgagaactcaatgaatcattcagtaacacaagtctaggagagagaacatttcactaaattgggcatcagttgagctgggaactaatgtaaactcggtagacctgtgaccttggacatgtcatttaatgcctcttggcctctgtttctgtttgtttgtttgcaaattgagaaactggctataagtaattactgtagcacaacaggtagctatgtgaactcttagagatgaacatctgggttaaatccttattccccaaccttgtcagttgtttgtagtccccttgcagggtggttggaagaaatacattaaattcttaaagagtacttatcacaattcctgacccatcaaaagcttttcataaataactatttatatagtctaggctccacatattaccattagttaatgaattttgctaaatttgtagcagtgattattacacgcaggacatcaaaaagccaattccttctacaaattcgtttgtatctctaaccaagcatcttccgcagctaaagccaacagagtcataaccacattattgatcactccatgtgggaattaaaagtaggtagcatgccatcctttttagtgtagtaactgatttactaattctatactcagaactagacctgacactgtggaaaagctggacccacatctttaaagttgtttcgaacaataagataaaagttttgttattcaagtgtccattttgtactatctgaaatgtgatcatcagaccagataattataaataaaaactggactcaaacaattagaaaaatacatgccccacaaagcccattatttactgaaagctttaacgagggtcaagaattatttttccaaaattatgtctttcaaaatttaagttgactttattcactcttattttttatttctaaggaaatacgatttagtagtaaataagaggagtggtgataaaaaaaacttcttctgatttcatgctttatattgggaccctcacaagcataatacattccaataataggtcgacctctcttgctatgattattagacaagttctgactaacaggatctgtctcttgcttgcttagaagccctcattgctagcccagaagcttaaatgtttatgtgttttattttttttttaaaaaatggaaactgtttctctttttttcttatttcaaatccaagtggcatagtggaaaggtcataggctttgtagtgagggagatgtgaactcaagttctgatcttgtcgcttagaagctttgtgactttgggcaagtcatttgttcagttggaaactctagtattgcctaagtaatgatagtcctgtattttgtattaaagatgaaataatataaaatattgcagagtgttatataataggtactcaaatggtaagtaagagctgttgctatggtcctgaaataccccagaacatgaaaaatgctcaagatttttccttcttacaacatattatgttggaaaagatatgaaagtaagctgtgtttactttttaaaacttgaatgtcattataagctggatataatggcagtcactacagattaaatgatagacaagctcagattttgctgtcatggaacttgaagtctaaaagaaattgaacacataaactgtaattatcaaaataggtagtttaagtgctgtgattaacatttttttgtgatggaagagaccacatctgtcttctctatccctattattttctgtagtagttgagacataggaggcattgaacaaatattctgaattaatgaataaaaagtaaatccagcttaagatgatctaggaaggattgttgcaggaattgatttttcattttgttagtctgaatatattgggggataaataatcactctctaggctccaggcagaccaaataatgcacacataacttttcctcaaggaactcttcatctatttttgttagaaaggaagttggagaatgttgggaaacaaatcaaatgcagtagtatgcaggcatatatgtatgaagtctcaaaggttgcttagaggagggaatattcctgctctaattttagctttaacaaccttagtcatgttactataaccctcttatgcctgagatcccatgtgttcaaaattagaggcttagtcaaaataatggaggccttcctcacctttggctttcaagggattcaacctgtctacattctggatactcagaaaaaatacgcagtcatttagtagaatgagagacagtggcccaacccattgacacctatgagggtagacctcatgggctgggcccactagaagtcatcattctgtgctagagcagcaagttcacctacataaaataaaagctttttcctgtcaccacatagtgaatattagggggtaagaagaacaatgagcaaattctcaaatggaagctcagtttgatgtacgtttcaactccacagtaacgctgaattatacttcctctgggaccactttagctcaccaagagtccaccttgatagatttcagtagaaagaaacagagacctttgtgtaaggtctgcaatgctgtattttacatctctttgtggagccctgaaaacatcaaaataaatgaccttgagtaccattaccttcctgtttctgtcagaagactagagaatgatggtgagagagaacacacacattgagaatgactagataaaaggcatcttcttctactttaaaattctccctggagagagaatcattcaatccccttggtagtttagaaagtgctacttacctgccaccaacacatgggaaaacataaacacacaatcctactgacctctttgagtcaaaatactttctaaatcacttcattaacataagaggcaagaagatggaaatcctagcacaatatttgaatttctagttcagtacacatacattagaggtacaattccttccttggatactaccattaaatttaggaaaagaatatttagttacagccttagttttaagtgtacttactcacctggcagaaaaatactactggacagagtatatggcagagaaataggcaaacgggaaagatgatccagttagttttcaaatccaatatgtctttattattcattcatttatccacgtaatccttaaatcacttgttcatttactgtgtctgacacggtgactgggcttgaagaagagagatgaaaggcacaaaacccctgcccttcagaagttcttagttgagtgagataaatagctaacatgcattggcactgttctattcttcagatctaatactcacaaaaatcctagaattgaggtaatattattatccccattttatagatgggatatatgggggcccagagaagtttaaacattattccaaggtcatacagctgggaagtggcagaactgggatttgaacctgggttgtcaacctgcagggtatgtactctcaactacatgtcataccaataacaggcatcagagacacatgagatgtggaagcatagttgctaagagtatgaaccctgaagttatactacaaagatttcaatgctggttttgcaacttatttactgtgtgacttttgacaagtgttttaatttttatggttttttttttttgtatgtatctttttcatgagctattgtgagatggaaataagaaaatgcatgtaaactgcctagaagagtatctggtttgtaaaatgtatgcagtaagtgtccgatattactattaataataagagtaggcctgggtgcagtgagtcatgcctgtaatctcagcactttgggaggctgagacaagcagatcagatcacttgagaccaggtgttccaaaccagcctgggaaatgtggagaaaccccatctctacaaaaaattaaaaaattagctggccatggtgttgcatgtttgtagtcccagccacttgggaggccaagatgggaggatcacctgaacccagggaggtagaagcttcactgagtcgagactacaccactgcactccaacctgggtgacagagtgagaccctgtctcaaaataataataataaaaataatactaatagtaaagctagtgtaagggaactacatgatggcataaaggaggaagggggtcatttctacttgatgtgtcaagggtggcataaccccttgtctcttcccaccctcaccacattatgctttctaagtaagtcttcaaggacagcccatgcaaaaattactacagtgacttaaggccatgaaatataacttataaagaaaaacaaaataatgaaattgatcacgaagcataacaatatcagtgtccagaaaacattaataatgtaatgccatgcaatgttttaaaaacacacagtgatgactgcaagttctccatatttacctaaataaatttgattataagaaaatttgataagtttggtgaaaaagaaagtttcttctgaatgactattgttaatccttaaaagagatgactaagaaacattgtagtattctcttttttggacacagagtcgtctctgcatgagttgatgtaatcatgacccagaagggtcaagataataagaaaagcaacagtcttctttgactatggagtaacattggtgatcatcattcatccaaagagcctaggggcttccatttatgaagcctagtacatggtctccagagaaataattataactatagaatgtaagtcctgggaaaaaaaaaagacttctgtggtcatttggtcaaaccatttatatttcaaatgaagacatggtcccagagaggctaaatgatctagaactataatgagtgtccccttatctctatttagaatctctgaagcaattaaaaaacataaccaccactttctcaataacatttttgatagaaaattccttttgcaatattagtatccatagaaaacaccaagtttagaatacttggaaggaaaatgacagcttcacaaggaatcaatgttcaatacaattttgttgaatgaccaagtggttgatctctgacttagagagagaatgcatgtctgtgtttttaatcttcatactgtaaatgtccatagaaatagagtttttaaaaagtgctttcactcagattatgtaattttatcctcacatcctcctaggagacagttaaattaaaaactattatattaattggacaaatcgggaaactgtagccaaatgaacctatgcaaggtatttacctccaagtaactaatatttgagaaggcaaagattgaaagccaggtctaaacaaatctttaatgctgttttgaaaaattatattagttgcttttcttccactctccttaattttgttttgcaatatatcagaaatattgtcacatctaatttgcaagcttccttcagggttaaataaactgcaagaatatttgaatgacaattcccctagactgttgaaggagggaaaataatttgacatgctttgtgcataagcacttgatgtctagacgtattatttcaatccaatttaggtgacttggttttttgtttttgttgtgtttttctttcattttaaagctattacaacatgattctgatgttgcttcccttttcttccttatttgaaagtttgtgccaacactcttaaaattgtatttaatttaggaaaaggtttcaaaacattggaatttcttctgttagggaaaatctgttagggaaaaagttgtttataaaacaaatataatgtcaaataatagctcttcagatctccaaaaattatattcttttcaggatctttgcaaaaatgtcatgttgagaacaacaaaagataatggaatgtatacagacactcatttttctgacattatatacagatgaatttttttctttgagctggtgacattttgcaggctgcagttgaatgaattgttaggaataataatgcatgcccctgagatggtgaagtgtagcatgggtatgtccacatgagactatattttagtagtgttttgggaaaattgtttttctacatttttcttaaatttggatcactttcttcttttcaaatgaccttaaagatatcactagaggaacacacagaaaataataagaaattaatctggtaacattccatttgtcctttaaaagaaagattcttatgaattttgttttgattgagtgaccgtgagcctcagtgcatccattttcactatatgaaggtattaaatactgaggatatggccggtcatgctacataaccaaataactattcttcttttaattaactttcagtttggtgggaggaatatatgtatgtagttaaataactaaaatgcaaagtatgatatattataaatatatacaagagatataaagttgaacacagtaagtgtttagtaaagggcaggtgctattatcaataacagttaataatgaaagcaggcataagtgcgtagataatttcctgctacagaaagcaggatgtgttattctaccaacacttctaccagttctgattgaggagaagtgtgaagaaaatggagaaacaaattaaatttattttaacattataatgtggttacatagtatcatcttaattagagccattcttctttattatccccatattgtgcttctgactattttgtagacaagaatactaagggtaagagagtttaagtgacttatcaaaagctacacggcaagaaaatagcagatctgggttttgaagtcaaattcatttgcttccaaatattaatacattttcttccataggacaataatttctattccactgaggacctggtacttgggctggaaccaacctatagatgagcaaaatattcagctgcagaagataggtagagttttgtaggccaatatattgagatgttgaaatattcgaagagacaagagaattcagtgcatattagaactatgctatgcatactcttaaatacagattaggaagtttgcttgttactttgtagagcttgagtcactttatattgtcacacaagagaggggcagctgtttgctactggcctctagtaagtagagtccaggaatgctgctaaacattctgcaatatataggacagccaccttcaataaatgattatctgttcaaaaatgtcaatagtgctgaggttgagaaagcctaatgctgctaatcagtctccattaagatattttaagttaaaaaaaaagagtggcagaatcgcacatgtgaaagatcactctacatcaaaatttaggaaaaattggagttaagatgtgactacagcctatattaaccctatattttgagtgaataaggctaaacaatcctaagatttttaactgagaaagtataaggcaaaaagagaaacaataagactctcctgcaatttgggttgtgtgtctactgctttatacctctaactgaagtcagaatttgaagtgtttaaggaccttggagagcacctaactagaccactgtttcccagatcaatctaggaattgggacaaactcaaaatctggttattaatacagattttcctgacctttcaaagaatggtttgtaaatctagttgggatttgaagaactgcattcttcaaaagtttcccaggtgatcctggaaaataaattttgagaaacaaaagattctagcccactctccttattttgtagatcaggccatgctaaattactcttctgatgtcaaagagatatttaatgcagttttggagctaaaattaaactgtcctgatgtacacgccaaagcttcttcagtaggtattgtggatatgctctgtaatggacacactggagatctgatctgtttctgacccattggtctatgtcacagggtttagcatattgccttctcagtcaatttaaggattggaaagccaatccttaaatataaactcagatttgttcctccaatatgtgatgtatttgaattaagaggtaagaatatctttaaagactctggcacctcagtctcatcctcagagtcattttactgtgtgttaagtatgtctcttttattttctggataaaaacttttccctccaagaactggatgtcacatggagaaaggatgtgtctaattcccagacctttggtactcatagtaaacctcagagattacctttttctaaagtcaaattgctcatctttcttgtgtgttttacttctcaggagaatatgttgttatgaccactcatttccacttgaagagaaagattggctactttgttattcaaacatacctgccatgcataatgacagtgattctctcacaagtctccttctggctcaacagagagtctgtaccagcaagaactgtctttggtaagtcccaatcaagatacatacgcaaggaagggtatggaagacaagttatgtcatatctgtgacactgcaaagagaaataaaaaaaaatatacactcaaatattaagttcatataacagaaagtttcaaggaattgccactctcattatggtatatattttttaaaactatttaactagcaagctgttttagtatttgtgaatagatggcattaatgaatatttgatttgatattttgaggtaaaaatgaagtgaagcaggcataaaatgcataatattaaaaactcataaataaaaacttaatatttaaacaatatatttagaatatataacatgaatcactgagttgttcgagaagcttagaaaatatcagcagagctacttatttacatttataaaaagcagagcttctttaagtagggagagccaattaatgaccaccatatcactacaggaataagtcactttacctgatgtgtgcacttctgtagagttacatgcattcattttttctattacaatatttttaatgacctacatgcttcaagttaagaaatctaattgagtattgtttaaagggtaaacaaccttttacaaataggaaaacttatttcctcatgtattattttagagggtgcatttgatataaaaaggtatttcctgcctatatccccgtatactatttcaactgtatttttcaggctgataaaaatgaaagattccaatacaatatcttctagacacagaaagcagtagtgaactgaacacaaatcaccactctcgttatgaaaattgcattctgaagcttaaaattgagtaatcataaaatcaaatgcttttatactaggcgctattctatacaattagcctgtattacttaactataaaacaaattctatctactattattatttccatttttaaaagtgaaatctaaggaacaacagattaagtaatctgcccatagttagaagctattagatggagccaggacgaagaccctagcatttagctctggagtctgttcgcctaatgacaatgctgtatcgtcacctctgagctatcctgctgcaatgaaaataattgaaatgggagtattgtggttaacttcatttggaaatcaccactacgtatttattggtgagaggtgcaattatcaaggttcattccacaaatatcaactaggcacctgctgtttttaagagctgtgctaaaggataaaagccttaagaagcttatagtctaaactgaggattattcacctgaagagattcctatggtatcatttttcaataatatgtagtgtatgaaaaatcagttatctcagaaaaaaagcaagactctgctacaagtaccagaaacgtgtattttcttctgaacttggcaatatgcttctagattggcaaacaccaaatcattgctccgacaattgcctaagcatatagctaaattaatattcagaataattgcagctgcagaacaaaagagcagttcattgcatactcattctttcccattaccacgtgtcgatattaattagcaatgaactcactaaagacgaagtcttgttaagatgcttatatctgtatgagtatgcctttttctcactaggaaattaaaacaaacaaacaaacaaacaaacaaacaaaaacaaacaaaaaacacaggacaggccgggcacggggcccacgtctgtaatcccagcactttgggaggccgaggcgggtggatcacgaggtcaggagatcgagaccatcctggccaacatggtgaaaccccgtctctactaaaaatacaaaaaattagctgggtgtagtggtgggtgcctgtagtctcagctactcgggaggctgaggcaggagaatggcttgaaccctggaggtgcagctagcagtgagccaagatcgtgccactgcactccagcctggagcaacagagcgagactccttctcaaaaaaataataataataataataataataataataataataataaaataaacacaggacatatttatgttttattttatttttgtagtatgagtacaacactatattggaaaaggttcctttaaaaggtgatttaccccttcccacaccaacgaattctactcttttgatttgaaaattatttacagcatttcagatggtgtatgtcaaaaaacattgctcttaactttttcagcaatcttatatctcaacagactcatggcctttgatgaacataactatatgtctgtaaacttagttgtgacaagtatttttgtgtttcaagttttatgtttctaatattttaagttcactagaatcacaaatacaattttctagacttttaaccttttaacatttattttgtacacatgtttctatgctttttagtttgaactcagcacatttttttttctgagctctgtgagaagcctaaaaggatcatgtagattcaaaaagaaaaaaacaaaagaaccaaacaaacaaacaaaagttgtactttataaccatttattaaaagacatccagaatgaaagaaggttgcagtctatcttgtgccttagaagaccatattcttggttttccatgctgtctctcatctggaggcagtgtggtcacttaattttgctgccaaatacatccaagtttgagattcagtctcgccacctaccagctgcatggcattggcaaatttacttcctcttatggagcttcagttgtctgttaaatgaaagtacaaggaaagtaaagtaatgctgttttttaaaaatttagcaaataaaaaaaatatacattgtcaggttccatacttgtaacttaaaagctgttcaacaaatctgtgttcttttctcttttcctataacaggaattgtattttcctatggcacaaattgtatcttcatgttaatcttctcaactgctcttaatttatggacacatttggtttaaaaatacccgttaccacattacttctgagaactgactacataaaccaagatttttttaaaaaaattgaatttattgtagtagggatttatcaaaaaggactaaagttgtcaattataatagtcattagttttgcccttattatcaggctaagagctaaacacttcattgcattaccttacttaatattcatgatagccttctgagttaaacttattaaatcaacttacaagaaaaaaattttataaaccccagaagctcgtgattttaagtcaattttctcaacgtcattcagcagttatagaacagggatttgaaactcggttgccctggactttcaattaccctaatatttgctcaagttaatactgacatgtaaattcaggagcctgaatttacaagtcattgcatttaatcctcatgatagtcttttgagtgagtgagcaaaaatgtccttctcctagaatttcaacaatggtatagacagtggagagaatgaaaaacaagtcatcccttttacagatatgggcacagagttcctacaggttaaatcacttagcagaggtcatagagctaataagtggtaggattgagactagtcactggaagaagtcagaattatttctacaatatgtagcctgatccaccctgaatgggtaactgtgactgtttttttaacatttttatatggtttaaagggaacctgacagcattatacttttgtactgagtatagtgcattacaaatagtaggctgatagtatttggtaaatgaacattagagggtatcatctttctcatactaacatataattgtgtaagtaaactaaaatgggctaacttgaaaacttcttttgaatagagggcattttaatcactagggatggatttgcagagtaggaaagatgaggcagtcttatcagaaagaaaaaagattctaacattcgaatcagaaaaactggtgttcagatgttggtactgctacttcttagctgtgtattctctagcaagttacataaaatgtattattatatatatgtgtatatatatatatgtgagtgtgtgtctatatgtatatgagacacacatgtttctatctatatatgtcagatttaggaatttctttaaaaatgtagctatttttgaatcaggaaagatagtgtaaaaccatgagtcaataaagtggcaattttccccgaatagttcaattatctataaattatcaaaaagtcattcactttctggtttacatatttggggtacatagaatattaaacagagctgagtatccagaagttacctgtggatcacaggcaagtgaagatctgtgatttctatatcaagaactaggtacagtgaggaatgttatttcttgttttacccaggacacccatgttcaaagcgccaatttaaaggagcttactatcttctgaagagcacctcaatagcagagcaatttattcctacaagatatccccctcaatgctgccattccatgaatcacagactacactggggttaaattaagactcatcaattctaaaccaaaataagatggtctagaaaccacattctgtcatgatactgttgatttccttttgttcaagtaggctgtcccatcatgatgaaatttcacagtatgaactggcatcatgtatgtttttttttttctttacaggagtaacaactgtgctcaccatgacaacattgagcatcagtgccagaaactccctccctaaggtggcttatgcaacagctatggattggtttattgccgtgtgctatgcctttgtgttctcagctctgattgagtttgccacagtaaactatttcactaagagaggttatgcatgggatggcaaaagtgtggttccagaaaaggtaaatgctttaatggtcactgtagtacatcaatattatgtctctttaaacctatgaaatgagatgttttggcctgtggtattggatggagtatgcagaataataaggattctttttttcttatgtcgtaaacaattaagtgccatgataattttgttattgataaagggagaggtcatttaggtgaatagatgtacaaagtggaggagataaaggagagtcaggaaggcaaacatttctagtcaaataggctttcctgtggtttctattgatttgagaacagttttaatgaacctgatattaggagcaaataaacttagtcaaatcctttatttaccaagtgcgttataattttataacttgaaagttatattcttttggttgttttctgagcctaatcatttggtcataaatgtataaccataatgcctcaattaaattaagtttgccacatgaaccatccctagttctctgcaaagtcaagggcaggcacattttctctttccaaaatagacatatgctttagggatcataacacacagaaattaccaagaaatgcctcatggtagaaaatgttcaagttaagaatactgctgcttctctcaattagaacctattacacagtatggattttatgtcacagcttgggaggatagctgtgtttgtggggtttgaagaacaagcgtgacaaaatgcaagtaagctttgggatgctgtgatgaagagcaaagacagagacaaagagattttaagatgtttagaaataatctagaaggagtcacttgacataagcttttctgaaactttattctatagaatattagtttcttaagatactctctgaaaatttagttctttgttgatgcccacttgaatattgctgcatactgtatttcctggtcacagcatattaaaggggctaagaaattctgtagtaaataaactggcttaactgtgtttatcccatagttaaacaaatgcattagataagaaaatcctctgtagtggtaacatctaccttatttaataaaatctaaggtgttgtacttcttgatggcaaaaggctattaaatactgcctgcatttttaatttattataataagacaggcataaattatgtttttaaattcctaaataaggcacagatttaggctgcaaaataagggccaccttgctcagcaacttataattttgcttctcactgtttactaaacaaaatgcattgctctttctttctacagccaaagaaagtaaaggatcctcttattaagaaaaacaacacttacgctccaacagcaaccagctacacccctaatttggccaggggcgacccgggcttagccaccattgctaaaagtgcaaccatagaacctaaagaggtcaagcccgaaacaaaaccaccagaacccaagaaaacctttaacagtgtcagcaaaattgaccgactgtcaagaatagccttcccgctgctatttggaatctttaacttagtctactgggctacgtatttaaacagagagcctcagctaaaagcccccacaccacatcaatagatcttttactcacattctgttgttcagtcctctgcactgggaatttatttatgttctcaacgcagtaattcccatctgctttattgcctctgtcttaaagaatttgaaagtttccttattttcataattcatttaagaacaagagacccctgtctggcagtctggagcaaagcagactatgcagcttggagacaggattctgacagagcaagcgaaagagcaaagtcatgtcagaaggagacagaatgagagagaaaagagggggaagatggttcaaagatacaagaaaaagtagaaaaaaaaataacacttaactaaaacccctaggtcatttgtagatatatatttccaaatattctaaaaaagatactgtatatgtcaaaaatatttttatgtgaaggtgtttcaaagggtaaattataaatgtttcatgaagaaaaaattttaaaaatctacgtctttattacacaaactatggtgtgcttatgtttttgttttgctttttaaactgatgtatagctttaacattttgtttccaaagctgaagatccccattctttctctttgaaaaaaaaaaaggcctaatgcattattttgtcataaaatgctattttaaaattcatggaactttcatacgtaaaggtgcagttgctcattgtagagcacatttagtccaatgaagataaatgctttaaatagtttacttcactttcatctgagcttttaccactagactcaaggaagaataattttaacagacatgtatactccatagaaactaaactaaaatagtttaaaaatattccctttttcaccctattttcagatagcacatgagcccaacactcacttaattctcattatgaagatgtttttagaggggcaaaaatattttgcaagctctggaattgttgaatgtattcttttatataactacattaaaagctttagattgaaatttatgactagcaaacaaaaatagaatatataaacgatatatgtaaatatacagcatgagattgtacattttttacttttttaaaattgtgttcttaaaatattgtgtaagaatcactgcacttagctgttggaatgttgttaaatgctatggaaatacatttagaacctgcatttaagaacagaacagcaagtatgaaccacatggaacttaaaacatatgggtgtgaagtccacttatgtagacaaaacttataatttccaaactgttgtctagtatacagtgatcagttgctctctgttcaagtcattccacacatttccctattttaggctattataatatagaaagaaaatgggaagcattagttggagctagaaaatgaactgtatattattgctatatttgctaataccaactatttcaataagtgttgtaccatatgtagcattaaatataaaatacataaaagaatgtacagaaaatagcttttattgagtaatattacatttcatttatactgtagcaatatatttgtaggtatactatgtaagggctttaaataaaagaggtccattaatacttccttataaaaattctagtctgtttcattactgcccagatgttttagagataaatatttatgcagaaggtatttttgaagtctccttttgtctgatagagtttaacagatatttaaatttagtgctcagaatccacaagtcacggtctaaacacacttagaatactacagcataaatctgttagcattattgccaaataagacagttgggatccaaacccaagtcttgagcaatgtttttctcaaaaagctgctatccaatgatataggaaaatacattgtgttttcctaaacacacttttctttttaaatgtgcttcattgtttgatttggtcctgcctaaatttcacaagctaggccaatgaaggctgaatcaaagacatttcatccaccaatatcatgtgtagatattatgtatagaaaataaaataaattatggctctaacttctgtgttgctgtttatcttgttatttttcggcgttatactaatgtgtttattgagagcattttaccttccagacttctcatggctaacttttggtctgtattttgctccttagatgtgaatatttcttattagtctgcttcctgctacgcaatgactgcatttctatcatttctcagtttgttagtatatgtggatagtattctactgtataaatgattgcaaagtttatcaaaaacaaattattatatgtagcttttctacagtgctttgctaaaccatgtagtactagttaagtcttccttgaaaataaagatacactcttataggggacagttcctgttcactcccaggaaacttttttaaaagatgacactgaatgtttattgcactttagtgcagtgaagtggcaataaaacctaacatgaatcaaggttgtttatggcagatgcatgtgttgctttacagagtttagcaaaagctcttaattttatgtcatactgtattctactgaataataaagctaacattattcaataataaaatggaa

SEQ ID NO: 20 - DNA, 387193 bp, Homo sapiens
gggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctggacaaactttgatggagaatttcacaccacgctggaaaaatgccggttatgaaaggattactggcgccgcaaaacaccttcctggacaccatcgccacccgttttgacggaacacgtaagtcttacacttgaacgagtggtatggcattttctgagactgatttttctcgtacacattacttttgctcccaccttcccttttgcaccagcggagtgaattttcttctgttcttgccaaggtatcttttgtgcggagaaatttgttccctcatggtttggtgtagtattaacactttgtattggtgtaatagttggctctcttgagttcttgggtttgttaaggactgaaacgcagcctgaggaaagaccgacgcccgtattcactgtgggacctgcattttggtgtatctttagggaattggttgtaattttctgaggtgaaaaggggaatatcggtgtacctaatctttctagagtttcaaggctccctagatcaaaaggagagcttggagtgttctttcttggagcttcattccgtgatatatttcggataggtatgattttctatctgagtttaagaaatgcaggattgccaagtgtaagctttctgtagaattttaagtgttgtgagtttgtcagaaccttgattcctgcttttgagctagaatagcgtatcttttaatccttaaatgagcctaacactcaagcagaggctgttcaggaagaaggacatgaataaagacgatttgatgataagagaaagtttttagttttttttttttgagtacgaatattattggacatttagctcatttaagctacagtaggaaaaaaaatagataggatgttgtgtggttgctagcagacggttcgttatcatctgcaagttgttctctttcaggaccacggtcaggtccccactccttctcaggcttttcaagctctctacttgaccctgtggatcttcctagctggctttaaccctgtaattaggagtctgtactaccacccctaacaaatgctctcagttggtttcactacgaatatcctcatcttctttctagcttatcttgcttctgtgcactgtcttccatttttctgttgagactcagagaaactcatttatcctaaagtccttcttagtggttcaagtgtcattgcttttactctgtatatttcttggagctgatatgggagagcaatactaatttcatttccactccagtagtctaaatacacagtcttatctttgggtgggaagcaagtcttggacttatgcttcagggatagttggaaaagtttacatgagaaagaaatgaatcactttaattttgttcagtttttatttttgacatctagtctaatcatggtagttggtgtggatatttggtcacttcataagtgtttttatctttacatctagccattcttttcccttttatattctaaatgtgttagatgttatgtatgaggtgtaatgttattacgtatgtcttttttagataataatgataaatattataggaaaacttcaagtccctgccattgccactaccacaccactgaagcgccacacaaaatcaccactgctgtgttttaccatgcatgatggcggatactactattttactattcattacctgaggtactgatcagtttaatgtggatgtttttttttttgaagttgaacatccaaaactaaaaggctgtaaacattgatcctgaatttgtctattgaaaatgaggtaattggcaaatggtaattgtttatctcattgccatttaaagttgaatgaagtgtaatgtgtagtgaatcatcccagcacagccttgggaattactgcagtgatacattcagatatcaattgctaatgagaggggctttaaatcatcagcgtggaaatatcttggcctctgactctgactatagtgatatgcatgataagcaggagggcatgtagggagagatggatgtacttgtgaatagttctttttctatgttggctacacattaatgttaataagataggttagatactttaaatccttatttttaaagaagaccatcctgacatacctgtatttagtatagtaagaaatcaaaaagtcttttggagaccatgcttggtctgtgctccacagcatctgggggattcctggagggaaccagtttgcatgaaatctgacaatcagagaagcaaatttgaaggtgataagtaacataagggttgactttggcaaggttttgtttacaacatttagtgaacacctctcctcccaagaaacccccactcaatgaaagagggttttcttttctcattttcttttcctttcttttttttttctttttgaatagcaggatgacttgaataatctgaaacttaaaataccttaaacaaaattttagccacaaattttggtatatctagaataatgggtataccatttttccagctagctatttactttatcttcttatgccattgtttcttgttgatacagttttgtaattactatctctgaaactattttcctatgataatccttacttctattgatttttatagctgtcatttattttcttttgcaagagaaaactatttacaaattttaaatttacaaaattgccacctactcaaaaactttgctggaaagtgaataatgttaattatactgaatatgtaatatgctgagttggtataatttttaccttatttgtgaagtatattttacggtcatgctagtttcttattttattttggacaatttttatgaaaaaaaaattagagagcaaacaacaaccctggcaaactgccttgctaatgtacccaacatgcagtattattattagccttattaatttattttattggagaataataaaacaatgtaagacatcatctgaaaatcctcccaggaaaaataaatatatgacaacataaaactctataacataatcctactatttatcagttgagatattatcacagggcaacataatggaagttaataatacattttataacttagtgacactttattattttacatattataatatttctttttaatatttaaaaagtgaggtctgtcaggattgaaagacacttgtggattattaattgaggctatttttttctgatatgcaatataatttgcaaccattattgaaaaataaaaatattatataaaattaccactaaatatatttactcttgaaatatgttttatggtttgtatttaactgaagtgtagtaagacttagaaaaactaagaaccttagaaatcttaaatacgtataccccacttagggggaaaaagaaaaagtaattccaattaatttctttgaattattacacatagcaaaaaccactcacttgtaccactctaagacatacacatacacacatacaccacacacacactcctaacgttatggcctgcaactagttcacttctccatagtttttttttaaaacatatttgctgtaatttaagaaaatcttttctgtttagacttttgctttaagtaactattaatttggacaaagggaaagtacaataagggaacacattggtatatatttgaaaaaatatataccaatgtatttatatttgaaaaaatagtatttttagtacaattgtttgtcacaggataccatttgagaaaaacagctttttaaaaaagatacaaagctttcagagggaagtatccattttcaaacataatggtggattagcctacattttctaggcatatcaaaatttggccagactacttcttcccttttggtttactaagacaaaaatttaagttttaaaggaagtttgtagcccagtggactccatcaagaagattccaatcaaagtattcaaaataatggttgtttagaaactcattaatatttgcatatattttatgcacttctatatagcctgtttgaaatggtccaaagaaatttgttaaaattgatgctgggcgcagtggctcacgcctgtaatcccagcactttgggaggctgaggcgggcagatcacttgaggccagcagttcgagaccagcctggctgacatggtgaaaccccatttctactaaaaatacaaaaattagccgggtgtggcggcatgcacctgtaatcccagctacttgggaggctgaggcaggagaatcccttgagcccaggaggcagaggctgcagtgagctgagatcatgcccctgcactccagcctgggtgacagagtgagactctgtcttaaaaagaaaaaaaaaagaaaaaagaaaagaaatttgttaaaattgaaatacttcctctacagaggaaattctcagtggttttttctttttatctttttgctttcatcaaggtacatagacctcttaatgttagaagcatagggagaaggataatgtacccattatcatactcttgactttgtagatgaattctgtgccctctaaaggacttatcacaggggttctgataacttcactacaatgaagaaagtgttagaattacaggaattggatttatgtctttaccagaaatgattttcttttgattagtgatatatacaaataataagaaaagttgtattgcacagtcttaaaagctaacatcagataattttgacattattatatagagaaaatggacatgcaatatgctgaaaattgaaattgtgtccacgatatagtctttctaggctctaacatttttcattactgtcagttcaaaggtcgtggcatgagacctcttctggccaatgagactggcaaaggacaaaaagtctttacagaagcatattgaggatcctgagttactagtttctgagatatcctagactcaacatacttctggaagaggcacagtctttctaaagaaatgtgtactttattcattcactcaatcatttttctttttctttttcttttcttttcttttctttcttttttctttttttttttttttttagacgagtctcactctgtcgcacaggctggagtgcagtggtgcgatcttggctcactgaaacctccgcctcccgggttcaagcaattctctgcctcagcctcccaagtggctgggattacagatgcctgccactacgcctggctaatttttttgcatttttagtagagacggggtttcaccatcttggccaggctggtcttgaactcatgacctcgtgatccacccaccgcgccctcccaaagtgctgggattacaggcgtgagccactgcacctggcccaatcatttttctaataatattcaatgaataccaactttacacaaagccatcatgctaggatatttggaataaatcaggattatctttttctcaaatggggcaatgtaacatgcacaaattactataatatagattagaaaaagataagtgtaattcagaaggtgcagacaaagggctatgcacatttgggtgagggaggaatagtttctatgcaggaatgatctgagagggcttcatataataaataactttgggtgggaatgattgtatcatatatgataggtgcaaaaacaatattctatttaatttgccattttgtacagtacttgtcattgaggctggaaagagcctttagtgagaataagaggcattttaaagggtgttaaggggtcaatgtagaagtaagagggcaatggaaagtaggttagaccagccataaaagatctttaaacccacagtttttggttataataagccattggaagtgatagatccatattttggtaaaaaactatggtgccatctatgtctagttaaaaaacttccaaaatgctcaaccttcccatgttctacagtctaaagcacactacagtagatgccaactttagacttgggatgtttctttttactatctcttctaataatgctttttaaaataaaggttccatagaatgcagtgaagttgatgtgttcattttcttaggaatgtttctttctcccagggagttaactttctcttaaggaagtgatagatttatttctcaccacacagctgactactcttctcctccagggcggtttacccctgtattattctagagttatgtccttggtcaagaaaaagaattgagggtttgctggaattcagtgccagtgaacttgattggagaaatcccaacagtaaaaggtaaagagttggaactgctgcaaagatagtatgcttcgccctggcagtatatatttgctgatctcatctaaatgctgtgtttaaaatccaaaatacaaacatcaaagatgagacttcaacttcacctatgacctagttcatatttggcaactggagcaattgaagagctttctcagtaatttaaacaggcaaatatagttattggattataaattccctggaagatatgttttgctttcctttatagttgttaatacaaccatctttgtcacataaactcttcaaatgccacatgtccccaaatgaactaataatcttttctagcctttgaaacctatttgttttcttacatgttccagcctcattattggcatcacgacccatccagttcttcaagctgcaaatctgagttggccttgactgcctacacatctaattaattatcaaatttttaatattttactgcagaaatgccctaatttggtacctcaattccctctttattgcttctgttttaattctgatcatctttttcttatctctacaattgcagcctttctctaactagacccctgtgaccatcagtcccttctactcccacttgttcagtttccattgttcccagagtgatttccattaaaaacaatattaccacttaatcatgtaacactcctgcttagagccatccgttggctccctgctgccttttggataatgtccaatgtccttggcatcatctgaccccaagatgattctgcagaatcttttccaaccactgtctcccaggctacacacatactcattctaaattccctgctctttcatggttttgggactctgcttttcacttgaagagcaagatgctttttgttcaagatccatcctaaagattacattctatcaaactccttctctgaggctccgagtaaagttacatgacatttcccctatacttccacatggccttgcccattcctctaatcagcttttatatgtgctataattatatgctttcatattttaacactcgaccatgaactccttgaagccttaactatgtcattactcccattgcttagacttatagttgaaatggtctttgctcagtaaatatttctttgagtaaaagaatttcaacttctttgaaggccagggctgagtattaattatatttatctccctttagtggtacctggtgttccttttattcactattgcatgattacctttagttttgagagagaatactggactgccttccagcctcttattttcacgtggttcaagcacaaatttcttttacaaactctagtgataatagtgtctatcatcttgggcatgtctacatgcatgctgtgtactgtgctggtgctttttctgttcctatcacaacccaataacccagcaaggtggaaggcagcacccactttttgagtcaaagatgacaaaattcaagcccagaattctactatatcatattagcctgtgatttttctactatatcatactgcctctaaaatgtgcttgtatagcaagtgtaaacagactagggtggtttgtggtatcgtttctagtttctagctcttgcaaatgagatatttctttaaagattttagccatttctagtttatatgctgtttgttcccctttggatatattatgctttaaatacttgtcatttaagtgatgttttaaaataggtattaaagattcataactggaactactaaatgcattcactgtgcaaagcagtttagctcatcaaagaaaatctagtgtccattttttttaaaaaggaaatccattttctttgagatttttctgtttagaatttgctgactgtagtactctctagtgatttccttttgttgtgaggttaatctgtctgtgaagatattctaattctcatagctattatagtgatatcattttggatatttaccttgttagggtcatatagaggaaattcttccatgtattttgagtctgcttttattgggaggaatatattttccagtgtcaggtactgttgacatcttttaacagaaatagtttaccttttctccacaatgaacttgcaggaagaagtaagggtagttagccctccaactctcaagtctataaagcttttttttttttttttaaaaaaaaggttttcttttgttctattaagtattttggacagacatctttattgtatttgtcagtccaaatgaatcttttattccagttattgaactaaagggaacagagaccagagcacttaccagtcttaccatgttttatttgattttctggaaaaaaggatccacataagaagttcagattttattgaaatgccaaatatccagtttgacaagaagtagatggctcttacctgtggtgttctggctattccttcaatggagagaataaagtagaaggtaaaattgggcaaggtttttaccttaacatctggataaatgttttgctgtgatttgatgagttatggaaaagaatgagggtattgggcctggggcaatgagaaggagcttttgtgttgtattaatttggtacagttttggttaggctacatctcagtcatctgaaaatgagcctgtccttctctctcaacaaatgtgtaattttaggttttaggatacatcattaataaaaatttaggcctcttgtttagctgtacagtactcatattatatattgtattattgcttctggcaagtcaaaagttataaaattatttggtagatattaataatggctaatatttgtatagcatttcagcattctttatgtcatcacttgaattgttttcaaattaatggatgaaaagtggtttcttgtgattgttaatgtccatttgtttactataattgaagttcagaattttttaatatgtttaagagatatttaaatgctttgttgagcattacttgtttatattcattgtctcttattaactgaattgttgtttttcccttttttgacatctttgagccatttatatagttttaaaaatggaacactttattagtaacacgaattgtatacattgtcccagttttggttggtcttttgatttttatatagatgaattaataaatttccctgttatgatatctagattttgtgtcatacttagagaggcattccctattttgaaattactattattattatttctaatttttcatttttgtgggtacatagtaggtgtataatttttaaaacatatcccatatgttctactatagttttattttacgtattcaatttttttctcctccattaataagttctgtaacttttactttcaaattcctatcctaagagtttatagacttaagaattggacaaatttcctaacaatgttattcaacaattcatcttctttatgttagtttgaaatgtctagtttatcatattttatattcctctatgtaattctatttcttgactttctatcctattatattaactgatctttttctgtatattttagtactacaattttaattatagaatatttgtgatatgttcttaaaattctcattccatgattttgttctcagaattttatttgactaattgtacttatttggaagtctgtatgactttaagtatcagattttctaattgaaaaaaatcctgatggtatttttaatggactgatctacaggaaatacgacatttttgtgatgttgaacattcatattcaaaaacttgctaggtatttttattgtttacaccttttgagggagttctcaataaaacattttgtacttattttattcctagtaattttatctttgcaattgctatgtaaaatagaaagttttctttcactgttttgctttttctaattcaatcatgtttgtttacttgaaggaaattaacttctatatgttattaatttttttaaccagccagcttactgactttctcctatcctttgtaataattctggtgttggattattgaagttttcagataagaaataatactggtcttaaataataaaaattttgccttttgttgctaatttttgcaactcttactttttcccttttgtttaattgctttggcattttaagaccaatgttaaaacatggcgaccataaagaaaacccttctccttcttaactttaaggggtattattttattgtttttctaatgagtgttttctggcttgttgtttgagaggtaaatattttattatatatttgtgctttattagaagactttgtaatgtattcctatttcattaagcctttttatccattgtcattttattatctatcgagactattctttctgtgttattgaatcaattaatataatgaattcaacagattttataatattgaactatctttgcatcccttcaataaaagttacttgctatgttgctggattttccctccactaataggacttttacactgaatatatatagagagatatatatgtaaaaatatatatacacacaaatataatatagtgtatatatagtatggtatatatatacacatatatgatatgatgtacatatattggaatttacattcttttcttggacgtgtatattatttgactttggtaaggaaactacacacccatatttgtgccgattacaaggtggtcccacctggtttagcatttgtgccgatttttcatattgtaataaggcattgttattcattgttgcatgaaaacagggccaagattggttggcagatctccagttcttatagttttggctgtggccttgtctaatagtgtctcaaacgtttgtgtagtgaatatagtttttacttcaatgtgtgtttaaatctgaaagatgcccagaaatatcacatatttttcagacacaaaaacatttgtatctaaacacttcagatacgaaacatttgtatctatatctatatctgtatctatatctatatatcatctcctttcctacaacaacatgcacattgtacaccaactagtaatgtctcatagtctgtgagagcctgaggttaccagcccacaagttagtggagtcagttggaaatatgggaaattatagtgtatgtatacatgcaatatatttagaacttttcagtatctttggtattaaaaaaatcctacaataaacctttttgggatcaatgacctaacaaaaatgaaaaataagtttaatgaattattaaattctcatttctaagaaaattgatgatgcatagataactgggagaaaatgcagacatttacatttgtcatgggtgcccacattgactgcattatagtcactgaccacattaaaatcagaatgcataaatctgctgaataagcatcagcatgtattttaaaaaccagtaaccgatttaagaagactgtacttaaaaattatgattcattctgcagaaggtatcttggacatattttgtgaagcatgacttttcatttagatcaaaggactgctcttccaaatgaatttcatttattcattttttttggtaagagttttttatgatataatttacatatattaaatcactccttttaagtgtagagttcattgaattttgcaaaatatatgcaatcatgtaaccaccaccacagtcaagatttagaacaacatcctcagccccaaaggtcagtaccctcctcccacttccagtacatagcagctactaatctatttttatgcctaaaatttcctttgtttaatatgtaattttaatgaaattatatacagtacccggccccttaacaagcagctttgctttccatgatttcaattatgttctgtgagctgaatcccaaaaatattaaatggaaaatcccataaataaacaatccataagatttcaattgcacacccttctgagtagtgtgatgatatctcacgctatcccactccatcccacccaggatgtgaactatctctttattcagagtatccatgctgtacatgctacctctcctttagtcacatagtaggcatcttggttatctcatcaactgttgcggtttcacagtgcttgtattcaagtaaaccttattttacttaataatggccctaaagcgcaagagtggtgatgctagtgattcggcaccaccaaaaagaagtcagaaagtgcttcctttaagtaaaaaagtgaaagtgcttcctttaagtaaaagagtgagaagaggaaaaaatatgctgaggttgctaagatccacagtatgaataaacctatctgtgaaattgtgatgggaaaaaaattgtgctagttttgctgtcacacttcaaactgcaaaagttacagccacaatgcatgataagtgattagttaacatgaaaaaagcattacatttgtgggtagaatacatgaacagaaacatgttccaattgagggcaattgggtttggtactatcgtcggttttaggcatccaccaggtggtattggaacatatccgtctcaggtaagggggaattactgtatgtagcattctttgtctgccttctttcacttagataaatgatgttgcaatttattccttttttcgagggaagcagtagtttgttctgttttattgttgaaaattttgttcattttgattccaagttttcttctgtgtgtagaaaagaatgaagcaccagtgattaatgtgttgttattagtaacagcacttggcaagtattcatgtcatcagggtttccagtggaaaaccagttaactttaataatggttgaacttttgtatctaattgaattgaagtaaaacttttcaaagttcgttctgtaggtgaattatatttctctgtaaatgttgttgtaaattcagtttaaaaggtcattaaagataaaggtattaattttatggtgacaaagcaattgtaaatttttgtagagcacagtaacatggcaaagactgctttctaaattaataaaatgtatgaagcataaatgttcttggacttgatgtagtgtacacataattcacttttgtgttaatcactatagaagctggattggtcaaaattaccacatatttttatatgtggtgaattaggtacagtaattacactaagtgattagatacattaaatacagaaaaactatttggcatgatactacgtggtttcttttttttaatgcctgttgtcagagttttgaaatatctgagcctttgaattattacttgtaaacaatctaagtgttcaacaaagttattagtcttttctaaatgagccttttatgttttctttacattttatttgaaatcacttgaaaatatttaaccaaggtttgtaattaaacaaaacactaaaaacttcatcttttaaacattttaacaaatagcaactttttaaaaacaaaacttgcagatagaagcacattgaaatgtactactgaaggccaggcgtggtggtccacacctgcaatctcagcactttgggataccgaggcaggtggatcacttgaggccaggagttcgagaccagcctggtcaacatggtgaaaacccatctgtaactaaaaatacaaaaaaaaaaaaaaaaagtatctgggcatggtggtgcatgtctgtggctgacgcatgggaatcacttgatcctgggaggtggaggttgcagtgagccaagatcacgccactgcactccagcctggacgacagagtgaggctccttctcaaacaaaaagaaaaagaaaaagaaaaaaagaaatatattactagataaggaagggaaaaatattaaacaatgagagctcaaactatttactagacttaatattaaaatgatttaatttttctttgagatattttaacttagaaaatattttggtggaatttgtttttaattagataaatttaagttccgtactgattttgcaatctctaaatctggaacaacattacaaagaatcatatggacacctattatgataaatttttatattacaaaaatgtttttgaaggtagttaccctgaatgaggcaaaataagaggtaatattttgactgaaatgtttgcactttccaatataaaaagtatataattcagaatattcgtagcatatcaaaatttgggggaaaagtagaatttaaaatatcctgtatatagcaaaatttgctgtatgcctacaggttattttagcaaccatagataatattttttcaattaaaatttttatggtctgttgtgaatagtttatggaagatgtcaacaatttcaaatttattaactatgaagtgcacctttgaggaaaattacaggcaattttatgaaaaaaataaaaataatgatactacatagaggaaaagcaaaaacatagtcttcagaataacaccaacaacttggcataagagacagatatggctaaatacatgatttaaatatgacaaaatataataaaatattattgtgtttagtgtactattttattttcaggtaatgtgtatatataaaattatatatatatataaaacaaataattttactttttaaaatagttttgcaaaaagtaaattttataggtttatcaatataataaaactagtcaaaactaaaaccaaatacttaaagaattatattattatttaatacttactttcactctcaaagcagtccctaatttataccttattttatactcacttcataaaatcattttcaaagccatttgaactaggcaggggttttgggtgtgcctcagattgccaagcacaaatttccaaaaagtagacttttaaaataatttaatttttatattatcttctgaggtagattgatcaaattgacaaaaattattccacaattttaattgttaatacacagttgactcttgaacaacagaggtttgaattgcgcgagtccacttatacaaggattttcttccacctctgcctcctcccatgagacaacaagactgacccctcctcttcctcttcttcctcagtctactcaatgtgaagatgataaggatgaagacctttatgattatccacttccatttaatgaatagtaaatctattttctcttctttataactttcttattaacattttcttttctctagcttaatttattgtaagaatacagtgtatagtacctataacatacaaaatacatgttaattgactgtgttatcagtaagacttccagtcaacagcaggctattggtagttaaattttgggagagtcaaaagttatatgcagattttctactggagggaggtgcccctagttcaagggtcaacagtaaatattaaatattcaacagctgatataacactgatatctctttaattttcatatgctagaaacattgacatgcagatgacacgtgtctcttttgacctgtcattgctcctagacatgtttattgtgctcacttgagagacaaggagccagagaaccctaaagaggctaagtatttttgtctcaaagctagaacaggagaaggcttggctgttattctcctcttaattgcaaaacccatgctcttccttcaaatttactgtgcttttagtttgaaaagaggaaaagggaagataattaacatttaataagcaaatttggacctaatgctgtacttgatattttcaccttccttagttaatttaatctcaacaacaatgcaagttagatgtttctgttctgactttatggattgggaaactgaagcctagaaaggtttaataaattgtcaaaagtcacacattttgtaagtagtgaagctggaatctatacacatggttttgacaatagcaggccctgtttaataaaaggcaaaaattggatctaaagtgtaaggcattaaatttatgattaagaacttgatgatcatacgtgacttcactgtgagatacttacaagctatttttatgctttttaagaagacattatctgggaagctcaacatataaagtcgccaactggcaatgttttataaacagtatttagtaggttactcaggaatttacctctcttgttagaataaagtacccacaaggctgtttttacctaaggagtaataacccactggtgttggagaattgagagctctgctgtaagtccaaagcttgttaatattataatatattcagagttatctgtaaagcaatgtcacactaacttgaattttaaaatgcttctggctcatcagtggttctttaggggtgggggtcaggatcaagaggggtggaattacaagagacatgaagaaacttttgggggtgatggatatggtcactgtcttgattgtggtggttttgggcttatacatctgttaaagttatcaaattgtacactctgtgcagtttattgtacatgaattgtacttcaaaaatgctgttaaaaatgatttctggggtggaagagagaagggtagagttaaaactacagcactattaggttggtgcaaaagtaatggcaaaaacagcaattactttcacacgaacctaatagaatgacacgtcctctgcattcaattttctcaactctgatgagcagccttttctggagtattattgtttgtgcaggtacagactattgaacgtaaactattacttgagaaacaagtaatgttaacaatgaacatagtcaaattaataatacaaacctattattttaacagtaaaattagattaaagttagtgttgattttttttggtcattagcaagctttggacttacagcagagctctcaattctccaacaccagtgggttattactccttaggtaaaaacagccttttgggtactttattctaacaagagaggtaaattcctgagtaacctactaaatactgtttataaaacattgccagttggcaactttataggttgagcttcccagataatgtcttcttaaaaagcataaaaactacagacttgttttctatgttagttatctactcacttgtttgtgagttgggtggggagtaatctaatccaagttgggcttagctgggttgctctgggatcttggctgaactcactcatgtgtatgtagattgtctacaggctctgctcctgtgggcttggctgaggaagctcaactagggcatttctcctccagatgtctctcctgaaatgctgagcgtgatcctgtcagcagaagtagaacaaagccagcccaataacacaaatgattttcaagactttgcttgtgtcatgttcgttaatatccctttggctaaagtaagtcacatggacaagcatgggcttgggaatgatgccctcccacagtgagtgggagctgaaagttatgtttcaaaggataattggagtcaataataaaatccatcatatttgccttattattgttatctttgggggaaaaataacacgtttcaaaaattaaaagttattttaaaaaaggttagacatctttttttgtaaaatgagggttttgtatcttaaaatggcttttttatttcctcacatacacatgcagttaatgtttacagtgaatgccatagaatacaaaatttatgatgctacctgtgagatacataaaaatgttatcaaaaaagagttctgatatttcaatatgattaaaaactgcacatgcaaaaaaatacacttttgtataatgctttgcacagtcagcctacttttacaagaatataagctaaaaaggatggcagtcaactcaatcctgttgatcagtgtatgctttgtccccagcattgttcgtagtacatagtccaaacttcaaatatgtgttggatgattgaatttgtaaaatatgaaaaaaaaactcgcctgcctcattggaagctttcataaagtgaagaacttttctagttaaaggaggcaaatttgattaaattgttggaatgctatccaaaaatggacagtaggcttggggacagcaataagaaaatcagtaggttctttgaaagtcaaatcaaggatggtgatggtatgtaatcttaaactctatgctgcactataaagcagcagggatatctagtacccttaaagcaagttttatagatttatccactgaataataaatttttaaatgttctgtgacaaagtcatcaatgtgagctatttgacccaaggtgacaaggccactagtggttagtatagaaggattgcagctctgtttaaagtatctcagttgtggtgctggaatgtctgctgttaataactagctgaggttatatccagcctcctgcattattaggtattgtggtatgtttgcataatatttccaaatgttctctgtcacaagtgtctcctttatttgttcctcatagcaaaatgagagagacatggaagacattttatcccaattctacagatgaggaaattcaacattatttggtttatagtcattagcaggtaaatgacacagacaacactggggccagttgtcctaattgtcagacctgtgttttaagttgtatcatattgttaccaaaaagggttgatgagggaattgaaaagatttaaataattgaaatctcataggcattgaagcaatgttggttttgctaacgtagatgtgtcatagtttattcaaaacatttcttcttataaatcgaaacatttgtaagatttcccccatttaaatgtgaatcattttataaaatgaagattcctctttcaatttataaactgaaaatttatcagtagggaagattatctattgaatcatatttttttataaatttgagaccaaggaatgtgattctactttccctctcaaaataaggtattcctgcattgctttttaggactttttacaagtcaatatccttttattaatgaaaatacttaaggcacgagaatcgtaaaagtgaatggcaatccagttactgtacacagattctggtatttttctattccattttttatagataactatagattcacatgcagttataagaaataatagagaaattacagatgccctgcgtccagtgtcttccagggtattcaactataacacagtatcacaaccagaaatttaacattgaaacaattcacctaccttcttcagatttcaccagttttacatggaatcatttgtgtgtgtttgtgtgtgagtgtgtgtgtttgtatttagttctatgccattttattatatgtgtagttttgtggagcaaccgccaaggtcaagttacagaacaattttatcacaagaatccctcatgccatagtcacctctctccacttcttttttttttttttttaagatggagtttcactattgtcacccaggctggagtgcagtggcgcgatcttggctcactgcaacctctgtctccttggttcaagcgattctcctgtgtcagcctccgagtagctgggattacaggtgcctgccgccatgcccagctaacttttttgtttgtttgtttgtttgtatttttagtagagacagggtttcgccatgttgagtaggctggtcactaactcctggcctcaggtgatctgctggctcagtctcccaaagtgctgggattacaggtgtgagccaccgcgcccggccctctgttccccacttctataattctgtcgtttcaagaacatcatataaatggaattatatagtaagtagtttttgaagttgacttttctactaaacatcatttccttgagattcatccaagttgatacatgcctatagcaatagtttctttttaattgctgagtcatattctacccattcatttttatctccagtttcttcctctgtaaattgtatggaatgggctctcaggacttgcaggtctcaagggctaagatgatttgtctgagcaaatggtgatgcaccccaaaagagccaacagacttgggtaaatgtgaacagccataaaccttagaatgagggcatgtgccatctgagtgtttgaatgtcttcccattcgtgtaactatcgttttcaaatatgaaggacgaagaataacagctttcaggaagtgtttaaaggattaaaagtgtttaaagtatgaaagttcattatgaaatttcctcagaaaaatctgtggatctactacattttcatcactccaataaaaaaattaaaatccaaaggtgttgaagacatctcagggtcggttttcaaactatccttcagcactcttaggggcctaccacatacctctcctgactttcctcctcaccatccctccgccaacaggagcaagtctgggatcattagttttcctttgaggaaggaattctgtggctgaaaagaaatttgaaaacatcgaatctgtcacctaaacattatataattgtcactgttttattaaatgagcacccagtgactcaattgcctgctcaaactcatttttatggagccagtgctttccttccacttggatgacatctgggccaagtttcacgacctgcctcttagaaactccaccccaaatctccaaatctcctaatctcactcttttgtttctttctttctttttttttttttttttttttgagacggagtctcgctctttcgcccaggctggagtgcagtggcgcgatcttggctcactgcaagctccgcctcccgggttcacgccattctcctgcttcagcctcccgagtacctgggactacaggcgcctggctaattttttgtatttttagtagagatgggttttcaccgttttagccaggatggtcttgaactcctgaccttatgatctgcccgccttggcctcccaaagtgccgggattacaggcgtgagccaccgcgcccagcctagcctagtctcactcttttctaacattggaatgaaagaagcgttgttaagagtatgcataactggtttttgttgaccgcatctgaaaatcctgtgtgttatttctcacctccctttggaccctggaggcattagcacctagtattttcagacctcaacagaaatggaaactgaaatagatacattatattatcctgttttataacaaagataacctagcacgtaattgtccctcaataaatggatagctccagctaaagtgaattttttggaacctatcaaggatccatacatattcttctaatgactgagaagttgtatatcattttttgttttgttttcaaggaactcaacatgattttatcagtaagattacattcaatactttgttacaaaaaaaagaaaccacgtattatctcatttatttttcacaaataccaactagtttgggaaggaatcatgtatgttcccatttgagatctgtggaggagatccacatccctgtgttccagccttatatccttcattcttcccttatttcactttatgttaatatttcatgctatcaaatttttgtgacacatttaaagaaatggcatcattcacattttacacacatgaatattgaggaaaaaaacattctaagtatgtctctaaaattgtgctaagtaaatttattgttttgtttttcacgtcctatttttacccctttcttaacagttccctaagctctatgtttaacacacacaaatgtatacacacacttgcacatgtatccacacacatgcacacagctatgtaaaatgtattactacttcaactgaatgttcattgcacccaaagtgttatatcatatatgatgtaatagggtctcaagcttacagaatttagaacattttacagtatcagagagttacatagggaagagatttggggaacaatgtgaaactgatcatgactcctccttacacaggcttaaggatgttccaacttcaatgttcagtcttccttcagcaagtgccccacttcttggggcatctatatatatatatatatatatatatgtatacacacacatatatatatacacacatatatatacacacacatatatacacacatatatatacacacacacatatatacacacatatatatacacatatatacacacacatatatacacacacatatatatacacacacatatatatacacacatatatatacacacacacacacacatatatatatatatatatatatttttttttttttttttgagacgaagtctcgcgctctcgcccaggctggagtgcagtggcgcaaaatatcggctcactgcaagctccgcctcctgggttcaagccattttcctgcctcagcctcccgagcagctgggactacaggcatccgccactgcgcccggctaattttttgtatttttagtagagacggggtttcaccgtggtctggatctcctgaccacgtgatccacccgccttcggcctccaaaagtgctgggattacaggcctgagccaccacgcccggccccttggggcatatattttgagtaaagataatatccttggccacatagtctctttcttattcttacttgttctaatttcctcacttatatattttttgtaaattgtatatattttgtgagcaatatgagtaatttcttttccggaacaattaatcatataaataaacataagttttcaaaaaaatcaatttttctactttctgaaaaacgttctcacttgccaagttttctaggttaaattaggtcccttggagaatacagcttatatttttgctcctgttcatttatctctctatatctatttatttctcagtgactagaggtataaaaactaagattcagaaaaaatgaatgatccctacttacaatccattttttcaagttgtcatcttttaagggttgatgaacatggtggaagtatgtggcttctcttcaagtcttcaattttcgagtattcattagctcgactctataaataagttagcctatcaagaccaagatgctgtgaatgacagctctgctcctctgattactagatccacttaaatgatctcatgtatacttttaaaatttgtatctgtgacattttttaagggagcaaggaaatgtgctaattaccttcacttctaagtttataggtaaaatgaaaactatctcattaatccagagtgagacatggccctgggttgacgatataaagtgagaaactgagattagttttgaaaacaagtcacatgcaattttactatgttggtgttggttagtttgttggttttttctgcttacttaattgtcaaggatcttcattctgaatgaggataagaacttgacggtgtttgcactcattgtgtgacaatggggtaatctcatctgagtatagtgattccctttctcaatcatgtaggagggagtgacaaagactcccactgtgtagatagttgctgtctgtcagtggattttctcggcaaaaatgtctttttcttctgacatctgttacttcacagtaatgggaatactttgactaccttcctgggttgtacaagtaacaaaagagcaaatattattgtaaattttgctacctcttagtatctaggttgtctttgcaaaaaaattgtatttggaactatatgtacctcagagaaagaggggggccttgtttgcactcattatggcattactttggtattattatttttacttatatacttctcttctccataagaatacataccccttaaagacagtcttgtctttttaatgatttttttctccagtgccttgcagagtgtcaaaacacagtagatataaaaaaaagtttttaaactgataagtgtgaaagaagaataatagaaagtgtttttctatttaactacctagactttataaaactccttgatcacttatattcaggagccatcattaccagcattgttgttttcatcactgttgtcatctttgtcatcatctcacctcccatttattggtctcttattaagtaccagtctctctgttaagcaagttttatacataacctcatttaatccacataacagtcttatgagatattgacctcagctccattttaaagctgaagaagcggaggtatggacaatgcaagcaatttgtcacagctgaacaagtagcagagtcatggttcaaactctgtacttgtcttatgttaggttcaagctcttatctaccttgtggttgtggcagaagttaccttcccccttccccccaccagtcttcttgattgtaccataaagtttttgtcagttttttaattgctctaatcccatctcctgctatctgcttacctatatgccttcttggatgtatgttattgaaaagaaaaaaaatctgagttaggttaattaaaggaataaaagtgagttaggttaattaaaggaaaaaaacacaatcctaggtatggagattcatttcattctaggtggctctcaactcaggctacatatcagaattgcctaataagtttttgaaaactgcagattcccaggctctgtccaaaaactgctgaatcagaatcccttaggagagatcctggcatctcatttaaaaaaaaaacaaatgccatgctgtatttcttatgtgcaacctggttagcaaatcagggcttaggtctgtgagacagtgacttgaagaagtgatttctccctgagcactggaccggcaatgtgagtgccttgggcaatggtggtggtggtgggttgagcaatggatgcctggacagtgcccggatttttcctagttatttttttcaacaaatatttattgagtatctgctatgtgccatacaatgtgcaagggcttacacctctgcaagtgtaaaaacaggaaataattcaaccaatagaactatttaatttttctttataattaaaattttgaggtatatccactttgttcacaacatactcaactcggatgtcttagctctgtgcccagtttgtaagtttcatagagtaagcgatttagagaagtcagtgcaggagagaaaggcataaacctacacacacacccacacacacacatccacaaataaaatgtctggagaacacactaaatcattaatacaagctactcataatttattttttatgagaaaaatgagagaacatttagactacaatttaaataaattcacataacaaaggagttataactgattctcttgattattgcatattctacatcttcacatttatcctcaaagtaaataattctctttgtgtccccaggactcatctaagcataaattcttggtaactgtgcttatcaggtttgactttgacatctgactgttctcacaggtgtctttattgattttttaatctgttgtagtatctagtatctgtgtgttataatcacattccttttttttctcccctattaccactctgactttgcctctccagctcaccacccccagcacttggccactcccactctacaccgcttgattctgtcttttgtctcctgtactgataaaaagaagtaagaaaaagattccctgtggcaggtaacattttcccccttgctcttcccacagctcaccactaggccccatatctacagaaatggatttcttcccttttttcagtaatgttctggcacctctacttcttgcattagctccaggccttagaaagcaactgtattactagggattttatttttctgaatattttcaaatacatttgaataaaataaatttttaaaacacaaatatggcagtttcctcaaaaatagtattaaaaatgtctccaaaggatcatacggacgtcttgacaagttcacatatcttagtattctgtctatctttagggaaatggaaaaataaatagaatggggttaagcaagctagtgaatagtcaaggatttatttaaaaagttctaatttggacctcattcaagttatgaaggaatattaattatagtttacattctcaatcttaagaactaaattaaaactgaacttgcaagtttttagtgagtttatttctgcattgtgtctgaaaacatgttctttattcaattagttaggcatttactacacgcttttggatataattataaaagtaaagaataaataatcactattctcctagtggtgtctagcataggagatggatatgactgttaaagtctggagggttaaaaagaagaaatatatgcaatttaaaatatttttattcctgaatagtaaatagtatgtgcctgttttgtttcagaaaaggaatatttgagtccatccatggttgttttgtttctgttaatgaaaatcattgtaaatgaaaggaagaaacacgcccttttgaattaggcactaataattttgttttattatgtaaaatctttgaccaattagtcagaatatgaagtagtatttttttaattaatgaatttggcctcttaaccttggatgaagtggcatgagttttagaggatattttcacaccagaaaccagtattttctgagtccagacttttgctgacagtttgcctttgtctaaatatagtaatatagagatactctgttcatatttacacatttctctaagaagttgttgacttgaaacctgcacaataactgttttgtaatttttttttttttttttttgagacggagtctcgctctgtcacccaggctggagtgcagtggcgcgatctcggctccctgcaagctccgcctcccgggttcacgccattctcctgcctcagcctcccgagtagctgggactacaggcgcccgccactacgcccggctaactttttgtatttttagtagagacagggtttcaccgtggtctcgatctcctgacctcgtgatccgtccgcctcggcctcccaaagtgctaggattacaggcgtgagcccccgcgcccggccaactgttttgtaattttatcggtcatgcttttttgtacaatttcttttatttcaaattgctccatagaatggcaatgaatttgtcatattttatgagactaaatagttaaaatactgttttatgattatttttcctataaactctacaaagaatacagtgactagttcttatacacttccttatatgtttcttttggaaatactgtcaaatcacctccttttcacagcttctaaaatgaaaattgatttgtcatcttgattcttctgttgatcatgtatttattcaataaagtgtaaaggctgaatataaactgggtatcctaatactgtctatgacttttcagaggggctaaaaaagatctgtgagctatttatatttagatttgaatacaagtccaagttcccgtatggcactcagatttcacattttcctcaattaataaatttccagcagctgtgtgggagtttaggatcaatttagctacgttagcttgttagaaataatgcataccaaaatgataaaaattcaaattatgatgccagtactgtctctagacttgtttcctgttgttagaattttctcagaaaatatgtccagctgagtttgaggtgaaatatttgttcacctctcgtcctttaatattttacttcagtttttctctcaagtagattcaggattcattttttgctaacaccctgaaagagacctgaataattaccttgttcagcttcttatttgaaagtaaggaagctggaggcttagagaggcacagctgtttaggatagaaaccattgtctacattgtgcccttactctgctgaaaatattcagctaaacagtatgaggctctataaacatgaggtagagtattctcattcaacggagacctttctagtttaagtaagaacattaccgagacagaaagtgttggatatatctgaaaatgctatgagattgtggttagtagtgcatttagcataattttaatatggaagacacattcttttttcctaagattcttttaagactatcattatctttaaaattatcagagaagttaatagaaatattttcttcctttaactgagaatatatactcagtttgaccagaacatacggattttgagcatgcagtgttatatagttgaaaaaagtagcttttctgacattacctatcttttgattgtttaatttcataactatatttcagaatattctattccatttatggttttgtgtgtatatgatatacagttgattctcattatttgtgttagttatgctctataaaattgtataaacactgaattagcaaatacttgaccatttctcctaaaggagatataggagttaagttcttgtgagcctctggtcacaataattttgtcaaacaatcaatacataaccttgttttatgtgtatttctatttaaggcaactttaatatatatttttgatttattaccagtgaacttaaaaccaatagcactataactcatgcttgaacaaagcttatctaacacatgtgttttctccataagtcacatcacagtcttgctcttagcaacactagacagtacttcagcattatacttctgagccaatttaaaaaagaaaattatcaacaaaaagcacaaaaatgcaaaaaacacggcactaaatagaacacaaaaaagacacttgtttttacagtatgagaggtaaaccaagaaggcagagcatcactttgttcagccacaggtgggaatgtgtcaggtaattcaaatattttaatgctttgtgtgtgtctgcaaataattgtaaaagattcatgagtactgattttgtggttataaatgagttttaatgagtagccaaattcacaaataaggcacccagaagtaatgattgtcatgcatctatgacatgttttggttaatatacaataggaattattttctattatgttctatcttttaattcaaaatacttggtagacagcagcctcccccattctgtacttctacttattattggttttagggaaatacctctttgtgtaatatttattatcttttaaatatatacatattaaaacttgagtatttaaatgcatgtatatttaaatacatgtgtattatttttatacacctacagagacagagagtgagaaagaaaggagagagaacaagggtgtgttgatgtgcaaaagaaagtcattttaaagaatcatgaatgaactaattattcatgtgttaatgtagcagcctgcttaaaaattatttgatatacatgaaattgacttaacctcttctgtttatagacaattaaaatgaaaagacttcataattaatataatcttaacactgttttaaaatgcagttaatgggaagtcatccatcttctgacatagttaattcagtttttgccacacttctagctactaaatttgaacatgtcattatatattagaaggtgatgctttgcttcacttttttttcttaatattaaagtcagtggaacatttgtttagtatattaccaactcagttctttattcatttatcaaaattaatttatgccttctagcgacactgaatagcacagggaagtaaatgcagtaattgggttgccaattccagaaaattctgcactggattgttaataagatttagaattgaggcttctgaaataaaaaaaaaattacttatttgtattatattttatacctggagatttttttattgctctatctttggagaacagaaatcattagtcattttaagtttttgttcattaaaaaattgtgaatagctaataaagggctagtggtctctttcagtctcttaatctttaggtcctaactcagtgctgaaaacataagttcaaaaattactctgcaaatcattgtgttacatattgctaagggagctgcttcaataaaaggatgaatgtttcttttcctcaagatacactacagtaagagagggaagactggcattactataacacagtataaaatggaaagattatacaaaaacctagcagcaaagaatatgagtgggcaaatggaaagcctgcttcataaggggaatagagaaaggagaatttagactgagatttgaattctgagtagaatctgttggctagaaagggagtgtggtcctccagcaggttttactggagcaggaaattcttgaagacaaacatagggaggcaaatttcaggaaggctgaaatggtaatttggacttatggttcaggtcttgcatgtcaagtaatatggttagactttaataaatagataactggagctattacaaaatattgaactggcagggagtcttgcttttaagaagaagttgtgtgttggctgagcattctgtcctcacttaggctcactcctgaggcaggaggctgtgtgttagatggattaggtaagatgcgacactaaaagcaaagaagcaaggtaggaattgtattcatagtattatgttacctgaaccagagtgggaaatttgaattaggaagttggggataaatatgagatatattgttgagaaaggatatatttttagtgtaataaacatttttttttcttggctgagagattatttaccctaaactagaattctttagtttttgtagagaatttactcctggtaaattactgtttttgttgttgatctggttttgtttgggatgggagaatgtttattatttgtttctctaacgcttgccaaatatgcatatctgtggtgatagtaaaataccatatatgaattatccattttgagtaataaagacaaaatatttggcttaatgctaaaaaactatgctgattaacaatttaatctttactggtcatttgaaagataatattatgggcctcactgtcaacattaagaatatcagttatgatccgtttttgttgtagttatttctctccaagatgaatgttaacagggacaattaaaatacttctggcagatattttagttaaaagtagaaatattctaactcatctcaggggcttgaaagatttggtagtatttcagaacaaattttgtgagaaagagttaaaatataagtatttttgaacaagatctgcagagagtttaacagaatgaaataatagtaacagctacaataaaatcattctctttattgtttccaaagaaatacaataacagatagtgttatttaagtaaagtcgtaggggaaacaggatattaatgcttgttgaaagatgctgaaactctaggtagaggagaagtgtgtatccatacacattgcactctatattcttgttctaatctcagtagggaagattataaagatggaaattatgtaaatgacattcgtggtggttttgcagtagagttggtaagtaggaagagaaggactttttcaagagacaccctagtaaaagtatgattatttaataaaatgcagaagggcaggttttctgacgtaagactgatgcttttatacatggccagaatcagagtacataggaaaaactgagaagcttttgtaccaagaagttttcttaaatttgtactgattactaaaggttgaaccctcaaaacatttaaaagtcaaaatcatgcttcagaatcagtattttctgctgaaaagtttagagaaaatatgctaggatagcctagaatgtattataaaactaactatttcaaccctttacctactttgagagttttgtgaaggcgatctggcatgacctacatttgttcaaagggccaagacagacttggcccttcaaagggccaagacagacttggcccttcaaagggccaagactctaatcagagctaaaggaattttgaagtatttatttcaaagtattcagagagacatgcttcttgttgaaacaattatgaaagctactattgaactgcctgatatttatcatggaataaacagaaggctgtcaaaatggaagattagctttgactttaggaatattacacttttggagattaggaattgccaacgttataacaagaataagccattagcagtttcattaagtttgactcttccaaaagttgccttatttcgggcaggttcttgtattttctgaacttgacttcaggcattcaaaattgctattgtggctttacaatctggttcactatacttacaaagcaaatcagtacaaagttgtatggttttttttgtttgtttgtttttttgtttgtttgtttggtttggtttgatcttttaaatctccccaaaaagactatttgataggctatgaggatatactctttgtaaaatattctgtgagagcatatttttagatgattacacaaagtttaaaaaatacattccatctgatacttctgctcacaagtaattgtcatatctaattgcatagggtgatcacagagaaaggatattggtcagaggaaataaaataaaatagaaattaaattcttttggtagactagagacagaaatataacatggtaatataaaaaggcatgcaattttcaagatggcctgaatattatcataacaaacataaactgttttagagaggattaacatttttatgaagttgctttctttccagtaacatgatatatttttatttgtcaaagcctatttttgtggcaagacatttttagtcatactgatactgaaagagtttatccctaataaacattcagaaaataatttttaaaagatatactttatcaagaggaaaattgagcccagaaggattgtgtgctggtctttgctgtttcctctcagatctattccttgcccttctcctgctttgttctatatttcatttcactccagaagttagaaaaagaaaaatggaataaaattaaagaaagtagcagaaagaaaggaggaggaacaaagatagatcagaaatgttcaatataagggaaagaaagagatgaacgacaaaacaagcttgggtttctgaataaattaatgatatgtaaatatctgtcaagattaatctaaaaagagagaaaagacataaagaaatgaatttgtaataaaaaggaaaacagatatttttaacaccctatgattaccatgagcaaatttaagccaatataataactatatgtaatagatgaatatctataaattgtaaatttccaaaattgactcaaaaaatagaaaagttgaataagcaaatagcaaacaaacaaatttaaaaaatcaactcaaagatgtttatagtttgtcctcattgtcccctgtcttgcacagacaacagaaagattattagcatacatattcaaggaactgatgatccctaatctcggctgacagtttcaacaaacagagaaagagtgaaatatccttgatctagaaatcttgttacaaaactggacaagaatagtaataaaaataaaattaggggccaatccttttttcacatacaaacacatataatactaacaaagtgaattcagtgttgtgcgtgacatttgtatagaaaagaaaatgaccaaattcctgggtatctataacacaggaaaagtatggttcctcatcagaaaacaaacaaacaaaaaaaccaaaccccaaaactgttcttttatatactatactaaaaaagagactggattgtaaatagaggccatatattctttgttattcttcccatcaagagatggaatctgcttcgctatcccttgaatctgggctcagctgtgtgacttgctttggccaatggaacattagcaaatcttattaaagaagaggcttggccgggcgtggtggctcatgcctgtaatcccagcactttcggaggccgacgggggcagatcacgaggtcaggagattgagaccatcctggctaacacggtgaaaccccgtctctactaaaaaaatacaaaaaaattagccaggcgtggtggcaggtgcctgtagtcccagctacttgggaggctgaggcaggagaacggcatgaacccgggaggcagagcttgccgtgagccaagatcgcgccactgcactccagcctgggcgacagagcgagactccgtccccccaagaaaagaagaggcttaaaaagtggttgtgcatcaagctttcagctttttttcctgctcagagccctgatataatcctgtgaagaagcatggactagcctctagcacaatgaaaagacaaatagggaaagaggccccagtagtactagctgagccctagtaggcctctttactgaatatattctgccttatgagtgagcgtaagtaagaacagaatgagttctgccttatgagtgagggtaagtaagaacaagtaaaattgtcataaaataacaagaacagaatggtcggccaacacacaactatttttttcgtgagaaatgcatttgaaaaatattgagaaaaaaatagttgtttttaagccacaacagttttgggcattttgttacatttagcaaaggctaaatgacacattaatgaatgatcttggatacagaaaaaatttaagtagttttcaatgcttcttcattatgaaacatcatagcaaaatagcagtacaagtttctcaacctgattaaaggtgtttatctaaaatgtacagttaatatatttagtggtgaagctttaggcattcccattaaaatttgggaccagtgaagaattgtgctattacctttcctatttaatgttgtacaggaagttctagccaatgtgctataataataaaaaaggaaatgagatatgtaattaagaaaaaaatagtatttttatttgtagacgatatcattgtctatgtagaaagccctggagaatataaatactgttagaacaaaaaaacacactaaagataatgttaaagaataacaaggtgtggagaccaactctaccagatggcaaggtttattatacattaaattatagtaagtaggtaagaaggtatcgtgcatgcatggaacaatgacaatggaatcgaatatacagccaagaaacagaattagatatttataaaaactgatataggggagagttaacattacagatgagttgggaaaagatgaagtggctattctaagtggactaaaggcttaaataaacaaataactaaaatttgactaactataaagaaaagatttacaaatgccattaaattataattgtaaaagcatttaacaacctcagcaaaacctgtggtaaacatatttgacgtggaagatacagactggaagtaggtatttgtcacacgtgtggctgacaaaataaggcatacagaattttaaaagaacttgtggttagtctaaaagagaaatggaccaacgcaattcacagaggaggaaactctagcggtaagtcagcataagaaagagaaagatgctgaacctgattagcaaacagggaaatgcacactaaaacatttcacatttatatggccagtgtgtttttaaaagtttgaatgtaacatttacggtattggcaagaatttagagaaagggattttaaacatgcttatgttcatatgaattcaaacagccactctgggagagcaatttgtcaagttacagtaaacttgaacataagcatgctctttgacagaacaattccacttttagaaatatgttctagaaaaccatccactacaagtacacaagaagatatgttcagagtgcttgttgcatcattatttataatagcaaattttactgtaaattggataagtaaattatcaatataatcatacaattaaatactaagcccttatgaaattgaaccacctaaacatggcagaatctcaaaaacataattttgagagagaaaatacaagtatgtcactgcttagctaaaattttaaagcatattaaaaatactgtatactgtttatagacatagctatgtgacaacagtataaaaagaagcatagtaataataaacacagcttaggatagtggatcagctgggaaaaaggatggaattttgatacataagcacttcaactgtatatgtaatttttctaatttaaaatataaagaaaaactgaaaaatcttaacgtttaataaggctggctgacaaaaatacattctttataactttacgaatgataatgatatttcgttttaaaatggcgttaaataaagttaaattctattgtagttgatgttggatttctcagaccctaggatgcactgtgactctctaaaaggtaaaggtagtatttggtatttttcaaatgcatttgatcagggaatgaattttgaggatatgtatggagacactagattattgcagaacaagtgggagaaatgcaaatcttgaaataaaaaatgatgtgaaattattttttagtgcaaatgcctgaggtctagaccatcatcttttctgaatatttcatacatacagaatcatacaatatgtagtcttttatatccagtttctttcatgtaacataacattttgaagttcttccatgttgtaggatgtatcaatattttgttattttatattggcaaatagtagtgcattatatagatataccatacttggtttatccatataccagttgttgattatttgaattgttcagtttttggctgttagcattattcataatactgctatgaacattttttgtataagtcttttgtagagagatgtatttttatttctcttgggtggattcatagaagtgaaattgttggatcattgtaagcttatgtttaactttctaaagtcctgccaaattattttttagagtggcaatacaattttacatttctatcagtaatattttcagtttctctgcatccttgccaaaacttttcattatctgtgttttgattatagtcattcaggtgagtgtatagtgttatttcattgtggttttaatatgcattcttctaaagatgaatgatgttgaacacttttcatgttcttattagctatttgatgtcttctttgatgaaatgtttatccaagtcttttgccatattttaaactggatgatgatgatgatttactgagttatgagagttctaatatggatgagtcctttaccaaatgtaggatttgcgtatattttcttcctgtaagaaataacataattttaagtgggacttgattttcatgtgtttcatatctctcacatgatattactttggacagaaagtactgctgtaaagatgatttacaagaggaccatttatcactgtaattgatagtttaggtatttagcatgcttatgctcctatgatttatttgctggggatttaaatcttatgaaaaatactaattcaaatgtattagaattcctacattctaattactggtaattctgtcaaagcaatggtcttatatttactttccacatttattcccccaatgtaaatattgtttaaaacattctttaaagttttcctcatgatttgcattctgagtggtaaacctctgcattcaatgtacatacacacatgcacacacattcattttctctgcttcaaaatgtaagttaatattttaccaattgcagatgttaccctcatagttgttggacaaactttagtgtctcatggaaaatagggatttagttaaaaaacaataaaaattattactaagtatgctttaaaaaacagcaataagaaacaattttaaaagtcaaatgcttccacaggaactagtttaatcagcattaaaaccttctggaataggtaagtctactgaatcacctctctgattgtctaggagacattgctgcatcgcacaattcacaggagtgtattctcccatagctttattttatatggaatgctcctctttaaaaaatgtaaaaaaaaaaaaaaaagaaaaaaaattgcaacgcaccattactgagcttgaaatgaatgtcctttacacttgcacatgccttttgtttcattttcaaaagtctctccaaaagaaaaccttgttgaaacacctggcatttcacaaattattgtgctgcttaagggcactttttctggcccttgtcttttattcatatattgaaagggcagagcataaacagatcacctttctgtgccctgccctcacatgatgtaagaggtggaggcagggagaataagacatattctttgatgtgtttctttgtttcgttgagggataaattttaaaaaagaaaaatcgtaactttcatatagatataaaataaacatgttaaagattttgtttaattcattattaaaaagggaactaggcagatgttacgaagttcaaaggagaagtgaatgaatcccaagtttttatggagcaaaataatgttgaaatcactgtacaaaaggagataaaactggcttttccattacagagaggggtgaaggaggacaatgtgtagtttttcaatggagacacccagtaatgttttctgcttcttaagcaaggattgtcaaacattttctgtaacatgccagatagtaaatattttaggttttgtgtgccttatggtctcccattcaattcagctgttgtagcatgaaagcagccatagataatacataaacaaatgggcataattatgtcagaataaaactttatttatggacattggaattcaaatttcatattattttcatgttacaaaatgttgttctttttgtttttttggttttcaaccacttaaaaatctaagactagtccctgctgtgaaccatacaaaaacagcctgcaaagcaaatttgattaacatttaaccaatagagaatatactgaaaaactcataactaaaatcagcacagatttgcaaagtatgagatttatagtaataagttattatacataataaatgtaatattgttacatatgtacatagtagatatgcatagatatatatatacttgtgtacatacatatctatctatgcatatatataatataaataaataattgtcatgaaataacaacaacggagcctatgctaaaacagttggaaaaaccaaggttgtctaagtacagatgaccataccttgttaatgtgtatcactggggttatatcacctcagttgatcacccacttcactcataagactaacacgacctgatggagtaaaaaatactgttctgtgatcagttacccagaagtattctctttcacaattggtttaccaaactcacatggaatttcaagcatatttgaaacagatagctttccttaagtgcacggggaacataacaaaacttagaacctgggtgttaacaaatgcataagatacagagcctctttatgtaagttaactatataaatatgagtgttttcattttattaaatatgttttaaattgtacatataatgtaatagttttccagatagtttaaaaagtctttgtgaacaaacttttatcagccctcatctacttgttggctgaatactctggtaaaatttcatgaattgggtacaggtacaaaattatgtctttaatatatttattgttatattacttattactgtgttttgtaaccactatacacgtaccagcgtcaccagatatattcttagggtccatgagcactctaaggacttcaaatatgcatttttatttttatgaattaactggatgtaatcagcccaccacatgttttttgttaataaagttttcctggaaaatagccctactcatttgtttgcatattgtctatggattcccactttatgaccaaatattgctgcacaatttttgtttctgtaattgtgtttatttctttagtgggctttagatgatgctttaaaatgtaacttttatgataatatttgtctagctgtgacagtttgcctcttgttgtagagtatgcaaatatattctagagcagagatattggcaatctttctgtaaattaccagagagtaaatagtctagcttttgcgggccatagaattccatcataaccatgcaactcggcagttgtagcgtgaaagcaaccatagacaatatgtaaacaaatgaatgtggttagtttccaatacaactttattaacaaaaacatgtggtggggtgattatgtccagagggccttagtttgctaactcttgttgtagaacatctggtgattctcaaaaatttaataaaaatcgatttataaatatatactctttaacaaatgattctataaagcatcacatttgcagaggtaaagtacgaagccattatttgcttagctacataatgcttccattatacaaatacaatataaaattacattattatgaatgttttatgttaaaataaagaactaggtttttaaagcttttttaaaaaataaatagcatattcctgaagaaaaccagcctgtattccacaagtgtttgtttgtttgtttgattgattttgtttgtagagagagggtcttgctatgttgcccagactggattcaaactcctgggttcaggcgatcctcccacttcattctcccaagtagctgactgcaggcgtgcatcactgcttccagctcacaagtttgtttgttttttttttaacacaaactacgggtagtttttctttttgacttatagccgtaacccatatatatatttgagttactaaataaactgcttctaaaaccctagatattggttagaacttttcatcctcagcttacaattgcaggaattttagatgtcagctaaatcaaaggtgtctggttgaagaaacaacaacagttaagatacattctctgacaggccagaaaggtagtttaaaagctggccagcaaaaatctaattgttcttgaacatattcaatgaatattcaatactgagttaatttttatgaatacatttataaatatattgttttgtttactattttaagtgaatctaacaaatgtttcatatgaaaattagtatactgtgatctctttcaaattcttttaaaagtcaagtaacattgattagatttattttaattatttataattatatagcagttcatattgtggggctaaattaatggtttcttaaaatttctgtaaatttcagtgttttggcctttttggtcttcatagcaatattttaaataattagttttttgaaagagaatttttagaaggtcatagtatgacttggttttcttaggaaaaatttctcatttaatattcagaaatatgtgattcatatttagtaaccaaaatttagaataagatttagcataccaaatctgacctataatcaccttcagaaacatagctttatctagaaacacattaatgtcaaatgttaatgatcttcctattaattacaaaattatgactggtatgccatttggtgaaatgatgacaaacttacatgaaatagtaaagaatgtgtgcaaactgaaaacagcccaaaacaattccatcacatatcagttgctgagattttatattttaattgctataaatacaaaattaaaactgacgctacttagatagattcatttaaaatatagagctattgactataattttaaaattcattaacatacttcttatgagttgatacatttggtaaaggttggtgattatttgatcagttgattttgggcaaaattgatctagtgctagcagagatggcgtcgttaagggagacaaaatacctttgcttgctgaggggggaatacttaaggtgagatatcagaatcaatatgtttgtaaagtccagtagttaagtaaacatgttaaaactggtgttcacaggttttccattgcttcaagaaactatggaaactaataaatgatttgtttcattttttttcacttacagaagttctaagggaaaaattttattcacttcctttttattgtatcagcagctgttcttcttgataacaaatcagcttccctttagttctctgaggagatccaaggtcttgccaagagcaaaagttgaacagatgcctcagtaaatgtagttctattcttggctagtcaaggccacttgtcttcagcagattgagttttttattgtttttgtattttattttatcctagaaatattttgaaagctgtaaacagcccaggtgaaattaattcgactgttgatgagttataaggaataaaatatataaacctggctgctttgacggaatatttttcctgtagtagctttgtgggaataatacgtgtccaatgtatttataggcaaagaaaaattagctgcatggacaagaagcctgatggatttaatgtggaagaaagtaggatgctgttggaaatgagctaatttactgaagcaacaagtgcgattgataatgttgcaataagtttgctttcacaatgtgtaatggatggtagagtttaggactgtgcgcaggaagaagtattcatttgtagcttcctgtttcaaacctccacttaaaatccctcaaacacgaatctcacgaaggtagagtagcttctacaagtttgtatggccttatttcaagtatgctgtgttagtttcatttttaaggaaatgaacatatgtaatactgcttttgatatgtatactgtagtaaagtgttggtcacatactttaattgttcttaaatttataagattactttcatcaaccttttgaactagattattttgaggaattaactttaagatgcttaatgtcagtttaagatgatcacatcttgaaactttcacagaaacttttatcttttttgtttcaaaaatggtgccataaacctaagtttatacgttctagtatatgtgtgtacttccacaagatagagccctagaaatggaattgataggtgaaaatatatttacagttaatattttaatacattctttaacgttcctgctaaattaatcatgatctcactgtagttgtgtgagaacatccatttccccgtaagcttgtcagcgttgtattttatcaaccttctaaatatttgttaatatgatgaacaaaaagtgatgtcatgttgttatgatttcgatatatctgattagtaatgaaattaaacatctttcacacagtaattgtgtaattagcatagttcttatcagtttaagaattaactaatgggcagattttgtttatttgtatgcatgaattttattttatagagtctttctaaggcttagggaaattttcctttttgttttttactatgattattcttttttctctgtcacctttctctagaactcctgttagatgcatgttagcctttcaatatctaatcaatacaccttttaactttgctctctcatactgttaaactttttgtcctctactgtccaaccctagtccactgcattctgcggggaggtcccacttctcagtcttccagattactactttttatcagggttcatcctgctatttagtgcttgatgtattttgttttgattttaattatgctgtttatgatttctataataacctatttatgtggttgtataattttttgttttttgtttattctcactatccttttggatattcatgattaggacattagttctacccatttttaatctttcttttaattttttttttagtctgtttattcatatttccttggggtagtagattggtatctccttatcaagttgatggttttctccactggtctcaggttgtacagccttagtagcttcagtataattccacagactggatgataattcctttttgtttgacagcaaatgcaagttctaaagacaggaattttccctcttattattgtttggggggaacaataaccttcaaccgtttatagttttcttgtatgtcctagaaaatgtgttacctaggattttgtctcatatttctggcacttttgcccactcttggagtctctcatgtaagacttcctactttgatagaatgtactcatgtttgttttcattttttgaggtagcaaacatagtaattaccaaccttaaagagtcagctactctcactggggttccaacgtgcttttatttttctcttgactgcttatcatccaatatttctccaaggaatggctttatcttgggattgtttaaggccttatctgattgagatagtcttaattcagttgaattttgatattagtctatttccatctgctttatatcttccaggaaattcacagttgtcccatattaccagtgctcttttgtatttacttttgtttttatacttgtccttttcaaaggtatttgggaaacgaggagatttgctcagtcagtaatcttctatttgaactaagaagaccacagttcttttattattgacataaaatgtctctagttaaacaaatggtattgtcatttcgagtaactgattatatttttttcaagttattccttttaaacttcctatggagttggcttggatttgtgattaaatttgatcccattatatttattttcacttagtctgattccaataaaagagatgactacttatcttgcttcagtttgaaattcttgtagcaggtgtatttagaaaaggtctacaaacttactggaaatttaacccaatcaaatattgttagaagcattagtcttcttttaagggcaagattgtcagtgatttaacatttttacataaatttttagaaagattcatttatagatgcattgaaactttcttattttaaaacattagtaatgagagagtttaatttgaaagctgaaactgatcccattcaagaattattttcatttcttattatacttaaagttttagattttcaaatacatgccatttaatagtttaaaaaatattaaagtaaacattttctaatgccgatatttaataagttctttctttgcaagacctgtaatttggtgctcaacacaaaggttatgtgtaagaattgactatgaatgtaaattagcaaagtttctgcatagataaaaataagaacaatcttatctccatggatactaatatttccttgtctttcagtcatgccattctctcccttttctccctgcttctcttcattttgttcatttatgtttaatttaacaaacatttatgcagtattttatatgtgcctggcactgtgttagacccaagagatacaatgatgaatagataagacacgatttttacctcatatcttgacctttgtttccgtgcaaagatcagatgagaaaggtataaaaacattctataaaattgtcttataatagaagatgttgtaaaaggtacaggtagatatacagtatcaatttaaattttgaatagagggaaaatgctataaaattaggcttaaaaactttcagattgttgtcttaagtactgagtattaaattggagataactatattgcagaaggagactcctcaaagcaagcattgtttcattgaagaaatttctttttaacttgaaagcttcaaacatcttcggaagcttattaagtattagcacttctctcttgtagtttttgtttgtgtgtgtgcaaaaataaaagagacagtaggtgtgaatgtttttttgtaaaccgtaaagtacttcataaatataagttgctattattgtgaagggaggtgatattgagagactatggaacaattttgataaggtgtagaaccgagcatatttggaaaggaaaagacagtaaattttaagcaaaattgtaactacctaaatgatatattttgaagtatgctcgaatggacttcatttccagaaacatcttctgtctacaacttgttatggcatttaaaattctgctggagaaattgcttctgtttgatgctaatagtaggtaatagtatgcattcaaaaatagtattttttaaaatgcagcagtttcacctttgaaagtgctttgctgtatttttattggctcttgataacattttgtgctagctgttggtgatggtattgttatcttcatcatctttattccttttctttatttgagcaagtgttagtagatatttttccttttttattggtgaggaagtaaggatcacaagttgtatgaattatttatccaatttttaatgagtgacaggcttaacccacactatcttacttctgttttctttctgctctaccatgattaaatccctaatgaaagaagtgcttattatggacctattatagggctaggacatttcaaagtcaaatagtacagtttctccatagggtgcacaagttaattggagatataaatcttatgggttagaaacagtagacaatggggactattagaggggaaagataaggagggggtaggggttgaaaactacttattgggtactaggttcattacctgggtgatgagatcaatcataccccaaacctcagcatcatacaatatattcatgtaacaaacctacacatatatcatctgaatctaaaatataagctaaaaaacaagagaaggtcgtaatacagtgtttcattttaaatactaagtggtgtgataaaagctttgattatttagacaatcgagaaaacaatatgagttggtttaggtcaaggaatggtttgttaagaggtggaattgcccaattatctaaaagttataacatatagttagataaggagtagaaggccctttcagggtaggttaaaagcattatgagcaaggccatcataactgaagtgatagaaaaaaatgattaataagacatgatatgttttaggggagaataccaataacttctataatcaaatttttccctgaccctcagctatagtataggaacacttgaaaaaaacctcttttgccagcttgaggcttgccaggagtctcataaccccatttttctgctgtcattatctacatctgtgccctaacccctgttccagtcatgagctttgcctgggcttcctgaagttctaagatgccagtgtgttaataattccccttgctggttgtcagattcttcctgtctctattctattctgactttttagaagggatcacacagcagaacttcttggccctggtatcataggcttttcattttctcgattcccataccccttttttccctcacagtatattcatgttgacagggtagatgaatcagagaggaattcatgtctcatctcttcatacccaacagagaacttcttgggtctcaacacccagacagttctggacatctgctttatcatttaacaatggaacatcttttactccctttatattttggcagaatttggccctgtgtataggattggtgtgctgcagtttttcgcctgtcactacaaaagcagaggagaagatactccatctacttgataattacccaggagtcagagcatggcctgtgacccaagctcagccaatcagatgtttcaacctggaactgattctagagcaagtgactcaagaaagaaagatcagttaggaactattggtggtgaatgatgtagcttcgatgtcagtggtttccagtactcgtcatttctttcagaatcatcagtcttgtaattggattttcctgttccttggtcctccagctaagatctttcctgtgtcctggtcttttttcagtttgcatcttcttctagccttcttgcagattctgtaaatctaatatctgtctatctacttcctgagtatgttttgttcatttccttttttaaaaaaattaaaatagcccaagttagtttatttttcttataagaaagtactctgtctgaaactcaaaaccctgttgccaagtctggcttattgggccaggctgacatttcttttcttgtgccagattctcttcaagagactcaagcctctcctttgttcagttattgtcttcctctaccactccaaaagtggccaggatacttgcatatgcctaaacctcataaaagaaatagttctactctttttctgaatcttctagttcacatatatattgataaaaggattaggtactatttaggaggtgaggagaggaaaagtgacatctaatcccatgtgttcggaagtttcaaatttctgctctaatccaatatcataggtattatcacttaatgctcagcaccaatgtaatgagataggtacttttactcagtgaaagactgaaatgaaaaaaaaaaagatcttggcttcattggaaacctagatttcctttagcacatccttcctggttatgtttatatggaggtctctgtactgtttattgtctttaaaataattacaactctgtaaactgtggaaagtggatagaagtgcatgtgattattgtctgtggatgtgtgaatacatcatgcttggtggaggctaaattgacttcctttctccgccgtggaagaacccagtttttagtctatttgtgtggttctctggattctcctttgagaatccaaaaaaatccaactagttgactgattatcttgttaattaataagttaaataaaatgtttgatacctatatgctttatgtttgtttgagggattttatcttttaaaaaattatcctttaacaacttgattttaccaaataggaaatattacacttttagtatccagtaatgtaaacatagctaataaatagcagaggtggaatttaaatccagattttccaacttcaaattcagaatttcccaaattcagatttacagaggaaagaagtgataggtaaaacaggggtcctattacttctgtccaactctgtacattagtgttcaagtaagctcattttctccaatctgttgcctttgatttttgctttacaagctactgaaagattattattctgaaaaaaatgctttatttctctttgtccttcccctcagtgacttccatggtcagttagaaatattttgaactgttgactccagaatttaatccacccccaacaattttgccctctataccctccaatattatctcacaagcaacacaccttattcttagtcatctttgttttctcggatttagttttctctgttatgaggccttcttgtactctgttttgctgaacctaataaaccttgaaaaatcattttcagtgaatttttatctctcccataaagtttccccaaatctatctggcattggagccattgttgcctcctctaaaagttagcacgtgtctgtttagacatttagcagttaatattaacagttgtctttggggtatgtaagcatttgtgcatcatgtccttaaaggcaatttagtgcagtagttaagaatacaggttttggagctggacttcctggcttcaaatcccaactttgccacttcctttctctacaaccttgggcaagttatctaaattctcggtggtttggtttctttatctctaggaagaccgtgagagttcctatgtaattggattgttgttggaattacataagttaatacatgtcgagtccttacagatatatttgcttcaaagttgtataaaattttactgttattgttgatattatttctattttactatttcttggcttacttttttccaactaaattttaagttatttgtggaaagaaataattttttaaaatttgtgcagtattttttacaaatctgatgcgtaatcactgggtaaagaggagctattgacaaatgcttttgagcagggttttgtgtatcaaaggcagtgtttaaacagtttgcagcaaggtgtgggaaaggttttcggaaaggttggattaaggactgctgcaataattctagcatgttataattttttataggtctccaattgcaaacatttattgagtattcgtcatgtgcctgacatagagataaaacctattgattcataatggacaaataaccattccaatcttcagagcatttaacacccagtacagaaaaattaataaatgaataaagaggggcagtccattgctgaactttatgtatagggacaggatgcagagggagagtaagatagtggtggtttcttgaaggaagtaatgcttaagccttgaactggaggagttgggtggtaaaaatggggtattattccaaccaagcaagtagagcaaacaaggcggaaccaacattgcagtgcaagacaaccgcagtgggttcaggtttggctgtggtacaaaataaagctggagaagtcacagaggtccatcctgccgtttaaaaaaaagatttggaccctttcctacagccaatagagaatgtgtgcagatttgagtttctaaaataagtcatcaataactttttcagactattgtgattctgttttgcctcattttaatattatagaagtaaggatatattttgcacggacagaattaatatgatagtgacccttccttaccccaagaacaaaaaaattttccaaacaaccattataacaaccagtgccaatacccactccccactgatgttttcaaatttttcttaacacaaaggaatgcactatatttagtttctagggtatttcttagaatgttgaattccattaagtatgccatggcttttgagatgaattagctgtctcactaagaacaggatttgcagaaacgaggtacatgttagtaaatatagaaagagaatggatgagaaaagaggggtttcaaacaaggccactgcctggaagagccacaaactaatcagaacctcaagcagtggcaggcgtcaggtgaacagatgataaagactgactggctgaccaagaactgccaatagtagcttcatatttatggaagaacattataaaataggaaatatgctgtaagaagaccttcccctcaaatatttaacttttaccatgctgcatattatcacactcattgtactgtgtcatcctactaaatatataaagtctgatagttatttgtgactaatcacgtttaaataaatcatgttatgtgttgaactgaacttaattctaccctttgtttttcatctgacagggtgcttttagaacagtaagttccacaaatgtcagagcataaactttcattatagaagctattcactaatattacataaatcgtaatcagaaacaaagggcatcacatcctaagaggcatcctttttaatcatgtaacaaaagaacactaccctcaatttgtaaatatgtatttcatcttgtaataccaaaaattcttgtggtgacaaaaactgctggacaaaaactgctattcatgtaattcatgaagcagaaatgtactttgatcattgctagaatcaattcatatataataactatatatttaaattttatataaataaaatatatgatgtattatatatttttatgttatgtacatataaatatatatgtacaaaatgatatatgtttttaaatgtcttagcaatgagtacctaaattttctaattataagggactagctcttatccttataaacaagatatttcttttggatatattgagtaaaatatgtaaatcactgagaattatattgataaatggcagatagtgttactgaaacatggtaatatgtgacataaatattactgttttagtttaaaaagtgagtggtcctttctatccgtatgaactgggttttattcagcaaatttcctgatctaatgccacagttcattatgaagaagttcatagtaggatttctttttaaactgctcggctataaattcctatgtgacgtgaatatcttggtacaagtttttattgtgatactgaagcatataatatcttgttcaatgaattcctaagcctgacaaataagtgattaaaaataaaatttacttttattaagtgattaaaataaaatttgatttttatgtgattaaatttttttctacataaaaaataaaacaagaggaaaaaatgggtggaagtaagagtggtgaaaaaagtaaagttaaaaaataaaatgagttccaagataatgttgacataaaagatgatcttgagaagttgctaaatgtggctgaaaatgtattcagaccgaaacataagcacaaataactggtagtttatttgtttttatgtgtctgtttttaaagagaattaagagataactaataatagtctattaaatgaataaagtttataaaattttatattctaaaacaaaattggcatgtcttcaaaatttactgaaagccctgaatattatgccacccaaccaaaattgtgaagctcttactacatagacagttgtgatttccaccttttttttttttcctggaagaatgttttattatcagggcataatcagtgtgatctttagctaaccatggttttcaattttacctatttttaaaaaaacttttaaattaacattagctcagcttcatctttattaactaatttttgttaaagatttgatgtcttcctatggtatatactattgtcagtttatagcaatggtagctttgacctatgaatctcccaaaatcaaactttgatcaaactttaatacacgaagttctcccaaaccgttacttttatagtgagagttcattagtaaatttctgtccttaaagttttgcttttttattaattttgaatgtattctcaggataagcatactaaatcattgggatattttgaagtatgtaaaaaaaattatatataagccgttattctcttaaaattgtagtatatacggccgggcgctgtggctcatgcctgtaatcccagcactttgggaggctgagatgggcagatcacctgaggtcaggagttagtgaccagcctggccaacatggtgaaaccatgtctctgctaaaaatacaaaaattagctggacatgggggcgggcacctgttatcccagctactaggaaggctgaggcatgagaatcgtttgaacctggaaggtggaggttgcagtgagctgagatcacaccactgcactccagcctgggtgaagtagcaagactctgcctcaaaaaaaaaaaaaaaaaaaaaaaaaaaaaaagaaaagaaaattatagtaaatacttatatacgctgctaacatttttaacacaacatgtttattttgttccttttcaagtttcaagttttcattgtcatctagatgttttctaacattcaaaatttaacaaatgtttttaaaaggtcaattatgtgccattgtgtcatttaatcccacagccttctctcctccaaggatgctgtatgtccgttttatacataagaaaactgtggtttaacagtgagaaaggatcatagtgacagagtgggggaacttgaacatactttttttgacttttttttatattctactccaccagctgctatacagctcaatggcccttagctatgaccttaatgaatgccctatttaaatctgattttttctgtcactaacctgggccccccacctttatttaataatctcctgggtaccttgaagaactatccatactgatattatccattgaattatcagtccaagacagaataagtacatggtatctcaactcactcacatgaagacatgagtttttgcttcactaagttccattctaatatatctttaaatgttttattaatacttatgttattactcgggagataagttgatggctttcacatttcagatcaaaaccattagatgttaatttctactgctctgaaaacaatgtactaatttccttttcattctaaaaacagaataacactaagaagtaaaacttaaggtcaattgattgagtttggcagatttctcactaattttagagataaaatccaacagtatcacttcataaatgtatttgcagcaccaaattcgttgagttaggagagttgggtttaaaaatgtccctcttaagttagggctggcagtggaaagggacttcatgaggagggtaatcatatgtcctgttttgcttaggccggtcctggcttatgcctgttgtcccatcattttatctggtttagcatgtatttgaagttttcagtttttaaggacaagttattattatttattttattaagatgagctgggttgggtttgatatatttctactttgtttgcatctcctgccataatttgaactagtagtttgtgattcccatgtgcaatgaagtcatttctaattttaacatgtggttaaatctgatagtcaatgaccagcctgtccctctattctcaaccctttccaactccagtctccctccaaagactatgtgaattgtgtttgccgataatacaaagacctctcagtcctcaggggctgagaacagctaactcctgcgccagatgcacaaagctgccaagccaccaatgattgcagttaggaagaaatatgagaaattatgcttttggtatgggaagtatgtatggaaaagagaggatgcacagtcctgttctatagagagtagtctgtaactttttgttattatttttatgtttatgtctataactatattgcattgtttggaaaaccttttttattttggaatcaacccttttggcttcaataacagagtaaaaaaagaaatgtgtttattgaaatgttaggtactaaatttatagttattaaaaaatgttgatgataacatgtaatgtgcacaaaaagtttgttgacatttaccacccattatggggactacacacatatcactaaccacctgaccacccgacgatacaaatttgctgaagaagtgtcagtgtccacttcaaatactgtttgcattttgttcaaaattagttagaaatttagaaccaaagtattcaaataatggagtagcaatatatttgtattttgaatacgtaataagctataattattgtgaacaatgcatgcaaacaggaacatattaaaatggatcattacaaaaggagaaactaagcaaattaaataatgagagccccccttgtgtagaagacttaatttgaaagtttataattgcacttgaaaatatcttgagaaatgggaaggatgttttgttagagctcccatctttgagttactcatatatttgaagcacttaaatttggctaaagattcaaaataatcagaatagagacaaattattgatgcttttttgttatagaatatttgtcaaaggaaatattctaaataaaagcaaaaaatctataagaatgtttacatatttcaatatagaaatattaaaattgagaacatattttatgtagcataatttgctttttgcttaccagacaactcagagaaaattttgcagttaaaaattttatggtttacaaaaaatgtaaattgaaaatgttcacaatttctaatatgttattcataaaaatgcatctttgaggaagtttgcaggtagttttataaaaaagcaaaaataatatcaccacattgaaataacatattttcaaaataatattagtgacatggtagtagggatagaaatagataagaaactcttcaaagtacataaaggtgtgcaaaaatgcttcctctgtttatgttttttctagactaatttcttacactatattttgaaaggttttacaatgctttttaatattttctaaatattttagcattcttaaaatctaaaacatctttgataaaatcaatgcaattactagaagcagaaagtgactgttatgctatgtttattgttcagataagatttaagaaatattttaatgttaatgtactatgtaaaataagtgccaattttatttttagaaagaatttcattttgagaataggtattgaatagtacattttattgcttcaccaatatattttaaaaccaaattttcaatttttaatcatttcaaaaattataatttatttgcattgctcccattcactgttaaatatcatgttaaatatcatctgatttggatgataaatcacatggcctccctgctcataatggctaggaccaggaacttgattctaccggcaactgaagctactactttctgtctctgtctttcctctgtcataagcatgtgtgatcttgggaatgaattacataaactaatgtgtctgtgagagcccatttctctataatggaacagttcttagaggtggctggataagaacccctacacagctgtctactgctaattgatttgaagttgaaaatagtagctttaaactatggtactctctcttgctgggagtgggggaagagagagagagagagagtgtctgtgtgtgtgtgttctgaacgcgatttaaaaataaacagacctactttcaggtaagtggttatcaatttttctttccttctaagattcatattttagccaaaatagtttttaaaaagcatgtaacaaaaacattttaaacaagttgggagaaaaaaatatcaaggttggggagggaagcataatgtattgtaaatgtaaaaaaatataatgcgctcacttgaaagatgttttctttagcctgaagtatttttatgatagccataattggaatccaaacaatgcagaaaattattatacaccagcctagagcaactccccagtcagggtatggaattgtaaatgaaagacctaaagatatcttagctccattcattataaatgaaatcaagatgcttttaatgaactctaaatattgaactcttcattcagatgctctcagaaatctttgcgcttgatcttcctgagtcttgtcaacatggaggacaaatacatggacaaggatgtcaaatgaagaagtacaaagagtgtttcctatacctattagggggcatatggtcatacaaaagaaaccaaaatagagatcaaaagaatacagtgtttatgctgtctattcgctcattcatccacccacccacccaccaaaccagtcatctacttacctgtttgttcaactacccatccacctacccaactatctatctacctatccatccactcactctttcatatatctaactaatagttgataaatgcatatttttaatatatttcaatggcaaaaaaaatgagaacctggccctgatcttaagttatttatagtctaatgtagagatttgatgccaaaaactatatttcaatatagctagatttctgcttatattccactgctttgggcaagatgagttcttttctgagaatttagaaaatatcctagagttactcttatgctaataaagttctgatcttcaggtgtatatagtcagtcaaactctacttaactattctagttaattttaacaaatatttattgaatacttataagccaggcactggggttcagagaaaactgataaaacaccacccttacactcaagcaagggggtatagttacacatagatttgttgaaagccaccccactaattttctgatagaaacatgctcagtgtactacaggaatacatagaagtggcatccaccctgacctggggtggtggggagcagtaatagcatcaaggaagatctctgtgaaaagtctaaaaatatgtatgaaattaaccaaagaaaagaagggagggaagggcattccaggaagcataaaaagtatgagcagaggcataaaggtgacaaacagtgtggtgggaaattattatttattttttatttccataggttttgggggaacagggggtatttggttacttaagttctttagtggtgatttgtgagatttttagtgcacccattacctgagcagtatacactgaacccagtttgtagtcttttatctctcacgccctttccaccctttcctctgagtccctatagtccattgtatcattcttatgcctttgcatcctcatagcttagctcccatttaggagtgagaacacaggatgtttggttttccattcctgagttacttcacttagagtaacagtctccagtcccatccaggttgctgtgaatgtcattaatggtatatatatattaatggtgtgtgtgtatatatatatatatatcacagttatatatatatgtatatatacataccacagttatatatatatataactgattgatatatatagatatatatatatctatctatatacatcacagtttctttatccactcgttgattgatgggcattagggctggttccacattttgcatttgcaaattgtgctgctataaacgtgtgtgcaagtatctggcctgcaaaagcataaggggaaaggcattctgggcagtagatgaactggagtggaaggctgggatctgtcatgcaaggacttttatgaaatttcaggaagcttgaaagacaattaaaatggttctaagtggtggggatgataatgacatagttagtttttattctagataaggtttttcaaccttagcactattaaccagataattatttgtcatcttatgggggctggggtgttatcctgtaccttataggattttgagcaatatttctagtctatacccggtagataagagtagcattacccagttgtgacattcaaaaatgttctggacattgtcagtgtcccctgaggagcaaaattgccctaagttgagaaccagtgttttggatgaatcacccaggggatgaactgaaggaagaaagacaggtgatgaaatcagaaccaaatgcagaaagaatttagagagaaaagcctgccagatatggcagataatttgagagatactgggatggaaaatatcggaagaagagaaagagcaagacaaagacagggagactggaggaaatcacgggtttggtttttgaacttgaaatttggggtgcctgagttacctccaggcaaatgggtctggcagtcagtggaaaatgcatacctgaaactccatgaagaagtttggtcttgaaaaaaagatttgggtgttgttagtaaaaataaggaaggaggtgtgtagaaaagcaaaacaagtgggccggcaattgaacttttgggaacataaatagaagagtatacagcaggagagaaacttatcaaagataatgaagcatcaggggtaaaaaaagagctttttgggaaggaagtgtcttagtaacaatggtaaagaaaggggcattcaaataggaaataaaatatatttttggagatagcagtttgagcagaaaatacaatactatatgaagactgttattttcttttgtagatttggtggctgacacatagtgtgtattcaaaaaatgtttgccagatgaatgaaagaatcaataaatgaatcataatgaattatactgaataaaggatctcttttaagaaaataaagtggatctgtgggcctagattattcaaatagtctttgattataatattatatcaataccatacctaagaaagtggacataattaatgcttcttctttgatcactttatgataatacaaaataatctgttaatatatatcaagtcttttgagactctcacgaatagacattccagggctatatttttatgacgttccttttcatagcagtatgaacaagtagatagctgaattaagccagtgacaaaataagtgcaatgtgtaattggactcatttaatttataaatgatcatttgtgtgtcttgaaatatgccaagttgtgtctagaagactgtgaacagctgtctcatagttaatggcttttctcaccaaaaatataaaaagtggatattcaactcatcaccagcagaatgtgttctagatatcaaagagggaaaaaatgttttcttgtgtgaaattttaatgtaattggtatggatttcaagatttaaaaaaaaatgtatttcagggtgctcagtttagttaatatcaactggcaattctaagaattattaaaataagatgttaatttcagttgaattaataaaactctagcacttacagcctttgcctgtttatctgcttattccacaagttgagagtgtcagatgctaaatactacagaaattcatttcccaagattcaagcacaatttaaagaaattagtcatgtactcttcttgtcaatgttgggaaaaaggagctaagcaaaatgctggcaatttgcaaaatattgcattatgttttattcataagaagatatttattatttgtatttactatcagaaagtacacatttaacatttcaaatgttgttatgtttattcctattgcacatcttcaatatatgataaaatatatgtaatctgttcagaagttgtctgagtcttaccaaagaataaattcactctctctttgtaattaaattaacatcctaactccatttggatatatgttttcaacaactttaaaaaattgaaaagagtggtgtgtgattctcaatcaagatgttatgatttgatactattaatcaaatactattaatacaccgctggctaccataaggcataaataataaattatagtccttatgctcagatatttccaagcccattggtgagaaggaaccccatataaattaataagaggacaataaaatgctgagcaccattaagttcggtgcaaatgtggaaagcatttaaggaaaggagagatccatgggaattaagaaagccaaaagagacttatggcagatatggtgttcttcctatttgtgttgatgttggtaatactccaaagagaaatttttcctctttatgggtagaaaagacgggaaaacgggggttgaatttgcctttcacaggagctcaatgttaaagcaagggatcaagagatgtcaggtctttcatatttctggatcccagggatatttttcatactttccttgttcagtaaacaaaatcacaaggatatatgtatatctatatctatctatatttatgtctatatctatacctgtctctcctgtctatatatagtatataaatatagactacacagttcacatatatattcatattataatattcacaaatatatgtgtgcaaagtataaatatatatgtatagccataaaggagtaaataaatgtgtaaaatatatattacaccttctcagttcccatcccttaactgctttggcaatagcttttaaagcattatgcattttttacttaaaaggattcacaatgattgccctcacatgcaaaccaagtctttttagtgcttagaagttactaatgaaaataaatcactaaaacatgcttttctcatgtaggaaaatgatttctacttcttgaggaaaatgttattttactttctgaggccaaggagttatgtttatctagaaagtaatgctgataaatttaagaaaatacttggatcattttaaaatgaagtaggttcttctaaacaaagctaatttagtctttgggattttcgtagggtttctaacactcactcagagattgactattacattgtaaagcattcaaaccagtcatgtagactaccttaaattatccaagatatttgaactcccctgcagaattaagcaaatgattgtgccttcacatctgctatgaatacacagcacagctccgtttactagattctgaacaaaaatcagctttgcttatagggaggtgtatgtattgtcaatggtagcatgaaacttaacagggaggcactgcctgttcactccatttgccaagaagagaattcagacaggattcaggtgctttttaaagatctggcaggacgattcctgggagagttataggtaccttttgagttatccttcctcagtgtaatgtgtagtccctaggtaagccctcaagtgggctttgggaagagatttttttgggggcggaaatactgcataaaccaaggctagatatttggcttgagaggcctgcatttcagagttccctttgccaaaagtcactgagtgaccttagacaatttatatactcttttctggtcttctctttgtacaatgtgaagtttaaattaggcagtctgcaagatctcttcccattctaataaaaggttatttagaatttcttatttatttctcggaaagccatttaatttccatttatttctaggaaacattttgtgagtgaagagatttgccatcacattttaaaattaagagagaaagatcagagatggaccagcagcacaaggctctcgatgttttttttctttcttctacttttttctttttcaattatgtgattctctccaaagtgatattacccaaatgcataaaatgaaattgtatccttccaattgtatacttagctgtgggatgattaacatcctaattgttacataggacttagtaagaaaataacacaaaacccctaccaccagggtgaataaagccttctttttggtgcttcaatctcatttgaagtgtaagatgtaagagaattcattttcatattttatcttcttgtgcatcacacttcctgaatgcccatttaaaaaaatatatattgctttcatcaagattgtccttttactcctgaaattctgttgtggagggttctgacacattgtaaaatggctgctttagtgttacagaaggttaagtttcataaacctatcagtaaaaaaaaaaaatttgattagaaaaaccgggctgtcacatatgttcaaataggagtcattcatatttcccagtgaatcaaatgagagataaaaatgaaggatgatggtgagaatacaaagtaggttcctctgacagcaccatctgggcagagccctgttaatattggaccctgaaagtatgatgagctttttgcattagtgctgacagcttccttcttcacatccatatgaacctgaaattaggaagatgtttgcatactatccaatattcaaatatttttatttcaataatgcctagttgatgccactatccttagccttcatctaggttgtttcagttctcctatacagtcataaatacatgatgtcccattgaccacatattttcattagttttctacatacgtttatgcttctcattttttaaagtacatgagagaaaggtattgtgggtgaaaagaaaagacatagtttccacccataatgacttacactggggaggcagaagaaaaacatatacaatgataaaaatgcaagagcaatatgtgagtatgacagtcaaagaacagatgccatgtagaagtgcatgatttatttccaaataggtttgctaacaccaagtattttgatttaaaagatggagagcctacttgtctgttgattggaatagtcagggcaggcttcatggaagaggtggggctggaggaagcattgaaagatgtgaaggattgggataaactaaaaaggcaggatggtgtgaacaaaggcagtatttctcaaggcgtagtctctgtaccactgctgatatgcacagtagacagatgtaacattaaataatgttgaaccatcagtgagaaagttttctctttccaattctcttcaaaattttttttactcaggaaaaaatagacctcagtctgatattttaactccttgctttacttgctagctagccagttcctcttcattccccctattctttaacacatagccagcaggcctcaggctccaagactgtgtcagacaacggtaactataataaaattgatctcagatcgcatttattttttagttctcttaatcttatggaaagtcatgctggatttccatttaaaattgtggtatgaaatgttttcatcaaataaatgtatttaaggaaaaccttaggcaacttaaggaaaagtagagacaaataatagtactagtgttaggacaaaatgtgtttgggtggtatgttaatcactgaatttgggagaacactgaggatgataggtagctccatgtgataacaaggagagtcatgatggacagtagccagaataagattagaaagactggttggttgtgaataggtcagaagatcagggaatgctagactcatgagctttattcatggtgttccttctcttgggattacattatcacctcttttatccagatagtaatagctgtggtttattgattccttctcagatttcacatatttattaagcatcttaaatataattattacatctttcatcacaactacattaagagaaaagtattaccttgattttaagagtgaatattctcaccaaaggtctcacagctaacagctaatagagctgggtttgaaacccagacccacttgactccaaaacttctattcttcaacatacctggcaactctcttgatcttcaagccccaacgtgaataccagctttatctgtgtgagccccactttccaacagatggttgatgtcctctttggccttcacacagccagcactatgtatttctgggtagtaatttattcttatcttcattagaatttacttggccatttactgactagtttataaatcctgaaaaggcctgttcacatgtctcaaggcatctagcactgtacttgtctcgtggttggggctcatactgtttgaattgagctaaattttcttcttttgccttagcttatcacagaagtacagaagtacagctgcaccacctcagagtggaagtgggaacaggagctctggcaaagataattcaggaactacctggaaaggatttgcctttgtcagactccaagaatctaattaattaattttgagcatatcagcaattcttcagttaaatcactttgtattttttctgtagctgggttttgtaacatctgggttaagtagcacaaaaatggatgcctaataattatagacttttgggtctcagaagagaatcttaaagaatatctcatccaactcctttattttttcaatgagaaaactgaagactaagggagtttcatgatttgataaagccacagagcaagtttagggcaggtctttaattaaaagtctctcaatttctcattaattatcttctatattgatggctttgagcttggagatcatagactccttctttgcacccaatgtaggaatctctacagcatcctttactgatgttaacaagtgctgcttgtgcacatggaacaggaactcattgcctttacgagtaatctatttctcttaaattaaagaggatatttcctctatgaaacctaagacaacattgcaatcctatcttttttaataggagtgttctaggactctgtttttgaacttgtccccttttccatccatatgcacctcattctgtgatcccatcagtctcaagcctttaaatacatctctaaactgaggactttgaaatttgtatctctggaacagcctcttctcttttgaactcgaggcccatgtataactgcttactgggtatttcccccctaggatgtctagtaggcatttctgattaatatcaaaaaacaaagccttgatttctctttcccaccaaaatgcttccccaatcccccagttttcttcagctcttgaattgagactttattttttctagttgcttgggccaaaaaccagtagtcatcttgatatgtctttactggcctggggtactatttcagtcatctgtttattgcatctcagctcagaatgcagtcttcagcatatgctcagtgataacggaattcctttaagtacttcccctttaaagagagcataatgttaatcgttctcagtagagggtgctagagggacaatagaggaggaaaaggctttgcaggctttttcagaatggtcctggtattggccatgtgggtaggaggacatctagtgaagtctactccagtatcaaggtcaaaacacagtccctctgcaagcctgcagcttcagcatggccatagtctctcctcagccttcttgacacagaaaccagaggtaggcatggctagcacccactgaagtgctcctattgctgacagcacctgggcttctaccacccccgcctgcccgtgggattagttgctgatcatctgctctgggctggcactcagcactctagagggtgatggcctattgctggcccagcaactccagaccacctctggcctggccatacctatgtaattctctacgacgttgggagctgaactgcactttctctaagtttgcccttccttggattttttccctaagccctaggataatatatagttacacttttatcagagttaataattctctatattaaatgttgtctgtttaatttaccatgtgacatctttatccggattggatccagattgctataggaccatcccatagctgctaggagcattggccacaaaacacatagctgtccctttccttggataattgcccttcattagtgggtgctgcctagctcaggaggttagccaccttttcctcctctcccacctatgggctagatccaatgactaaccgataaaagccagctcctttgacttaaggcaaggacaattctgtgggtacactttgcctcctaacttcccctgtggatcaggccaaggctaaactttaccagaaaccatgtcttttctcagctttctctctccttctcaatcctgcttcccttattctcttatgtgtctttcctgagagtattccctcaataaactgggtatatcctagcctttgcctcaggctttgcatctggggaacctgacattagacatgtaccaaggacacagtgctagaagatagtgaagttagtaattataccaaatctctctaactccaaatctcgtgctctctaaccagcattgtctcatagttaagatactctttcaccttcaacatgttctccctaatccagtatgtcttccatgctgagccaccttggcctggagaaaggtctgccattagatcagactaaaatatgtgattattgatgcaccaatatctaaggcctgtgcccactgttgccataggtctgcacgcccattatctgtttcatggaggcttacacataccctgctgttactggcttgggcctgtatctcttccctagaatgtgggccagcattctaattggagctctaccttcccagttccttgaagtgagtctgcatgtctagctaaatcacactgctattctcccatcaggtttatttggggtagagtagttctccatttcctgggaattgtgcactggcatttactaaggtacagaaactaagatgatatcttgacacttgaatgccttttaggtaaataatctatgagtgggggccataacagtttatttataatttctggcaccacacactagcacttattggggaacggggtagaggcaattgaagtgttgctcagagacctgggagaaccatgaggacctagatttatgagagattgaaagattgaaagataattgggccaacactatgtgagaacagcttctttcaaccgattctattttcagatgctctaaaacacagtgaaagattcagcagacaagtcaacaggtcttggatctaattgtctcttttccatgatcccagcttatgttttgattttgtggtttgtttttgaccattgcatgcagatccctttggggatttcttagcctactcaatgctacttactagagtatgactccaaatttcccatatgactccaattacttgacagcccacaactttttctctccctttctcaaaaaacaaacaaaccaataaatgaaagactggtattcttgctagtaggctctcctttctgcagagagacaatttacccacgtcagaaaggtgattacactctcttcggcatagccatgttttctttgtggctggatgaagtacatctgtagctaattctgtcacatttttagtgtcccacagttagatgaaattattagccatttctacagagtgtcagcaactgcaaatagaaatgtgcctttgaaggcagctggatccaactgggaattgaaaaattaataggaatttagaataatgggcatgtttgcaatgaaccatttatgggttcaagaaacctagttcctctggtaatttgaataagcagttttgctaacaaagtttgtctattaagtgaacctgctggatgtacctatcattcacaaacaactcgaattatcactctcccattaaattttaccctttccccttagcttgctggtttgtggaattgattctctccattctaggcagggaatggagagagaaaaaaatagaaacaacttacagtgctagcagaggcaggctggcctacttctccatcagggacgaagagtgtttgtgttacacacgtaactttggatgaaattcatgtgtattttgcaggtaactttggacgaaattcaagtggtgccacatttatttgaaatggcagatattctcaatagaaattctcagttattatcaatatctactagtaattcttgatacttcttcttaatagatctccagtatcatggtccttgcccctctgaccaaaatggattttaacctcaggaaaataagcaagtgtcaccagcagcttcaaaatgtttataatcataattattcctcatactactaaaatgtgttagagtttccttgccacctttatttatgtgattttagtcccttttgtgtaacttccctttccccagtggaaatgtgtgtccctcaaggaaatacaatgtgctgctcactcattgatacatcaggaaccccttttatgttctcttcagttttgtagcagttagagcactgttctcaaggaaacagttatcaacaggattggtttttccatttggctctgagattgcagcagtatggcaacaggccagatccaggacgccgatgcttgccaggaagggtgaggaaggagccagggatctcagagatcaggttgagcaatatgagagcaggactttggtgcaaatgaagcagcacacattttagctggtgtgaaggtagaaaagatatttaacctctttgagatcatttcttcatctttctgtagaggatgatagcaagatgcacctcgtgaggttattgtaaagattaaaggaggcattcatgtgaagtctgagcgcagtcccttgcgcaaggctaacatttttgtttgggtacactgatcatcactgctaattcaagttgaggagaaagccgtctgctttgcttggaaagtgttctatttcagtttatttagatacatggcttaagatatttcaccttacatttctatagtttataaaaatctattatgtccaaactttcaaagtaggtgacccattctgtgagcaagttgcacacacaggcctagttatgagtagttatgattagcatacatattgttttctggaggcaaacattctaagagcctgaaaagtttggctttaatatatgaagtctcttcctttttagccatttttatgttttttatttgttcatcaatactctttcctaggaaatatataattacgcatttaacaaatacttacataatatttacagagtgccaagcatttcctaggcctattataaatattaattaacataatccttatgaagttgcttctattattattcctgtgttacagatatgtaaactgaggaacaaagtaattaagtaagttgctcaaaatctcgtaggtattaagctgtccagctgggattctaatccaggcaggctggcttcagcgtctgtacttacaggtatcaggctagaccaatctagcccatttgtacggtcgcagcttttgaataactggatttgggattatttaacttgttctgtgtgtctgtatgtctaggctttctgagttaacttagacttaccttatttagtttgtttgggactatggtactaactgtaaatttcccttttgcataagtcctacaggtagggagtttagggatgcaggaggatgccaggcagtggtgttaaggacttctctaaagaacctgtgtcacataaactaggagccatggatttgactgacttaaactgttttctcaatccaaactagattctgagacttctgtcattttaaattatcttaggaatcccttcttagtaattcaaagtaattctactcagcacaaatagaagacctatgtactgagaccaggatttttttttattttcttgctaataactcaattttagaatattttaaaactccactaatcataatgaaccctatgaatttaagaaatttttaaagtttttcaactagtttgtgtttggttttgaagaagttagtgaacttgttggatttccgtcttagtacttgtccctgatccaccagcagtggtctgcttttataataccaactgaccatatttttagtttgaaaaacaccatgagctttctttgctatacatgctcctggttttcctgccacatcactggtggctcctttgccatgtccacctatgttctgtgacttcataaaatcgaactgctccagaactcaggctttagtcagatcatatcactccttcactcaaaatgctgtaataactccttgtttaaagtccctgcggtaagactcttcatcatctggtccttcactttctctctggcctgattgcctattgcattactttgctatggctgctggaacaatgtaccacaaacttaaatggtttaaacaacaaaaagttgtctcatggttccagaagctgaagtctgagatcaaggtgtcagcaggccctgctccctctgttggtgctagggaagggcctgttcctagctcctctcctagcttctgatagctgtttgactggcagaacaactccagtcttcatatggcattgtctttgtgagtatgtctatctctgtgtccaaatttcctctttttataaggacacagttatattggattaggggcccaccttattccagtataacctcattttaactaatggcatctgcaattactctatttccaaatcaggtcacattctgcagtactaggggttgggacttcaacatatgaatttggacacaattcagtctgtaacacctactatgcttcttcctacccactgtggggcagccatactaccctctttgaggttttttgagtacttgaatgtgctgctgccctaaagtctttgccttgtctgttccctctgcctagaacactttcatcctcactaccactgtcctcatggattataaactcccttctttaagtatgtcttcaaatatgccctcctcagtaatgcctacccagatcaccctatttaaaatcttaccccaactcctcctcatacccctcaaactcttttgtctgttgcttttcttttttccatagtatttatcaccttataactaaaatgtttattgtttgtcttctgaccctgacactggagtgtaagccctctgaggggtctttgtctttttttattctgttgtaatccaagcacctacaactgaacttgagacttaacaacaggtcaaaaaatgtgtgtagcattcccatttttctttgttgctttagtttgagagatgcaaccctttaatatattggagtaaggcaggtgggagaacggcaaaacatatctgaaacaagtttcttgcacactgcaacatggcttttccatgccatacatttgaggcttttagctaaatgccatcttcatgatgactgcaaattcttatgggtgcttgccatggctcccttctgagagctcaaagcattctcttcctacagagtggaaccaagctcttccagagatgagagaggcctcatctgacttggtctgacatcacttagcatgcggagaagcaatcactgaggcttctagaagggacctattactcaggtcaagaactcaggcatcatgacttgctgtgatttttcctactagcatcaaaagcaaaaagctcctaaagtaaccacaaagtactctgagagacatttctctggcttcactggagaggacacggtttaaagggccacagacgttacatctacttgccttaataatcacatcaaggtctcccatggttctctcgtagccaatgtgtcaggagagattcccagcagaactgctgagctagccaagccaccattttatattaaaattgtctatttgttatcagcctctacctcatagaatgtggaggctgatgagggcaagcaggtcttggccattgctgtttttcattctggcgcccagcatagatgctatatatggaaaatgcttggaaaatccttcttaaaccccagctgaagtacagtctcagagctcagcccacacaagctcatgcaggttgcatcaccacccagctacctgggttacttatcatagtggcatggtccatgcctttgttctttggtttagtttctccttaaactcatgaatggcttgcaaaaataaatgctgaaacactgcttaagcagttcttcttgcaggggtaagattggtgacgtgtaggagagtctgaaagggtgtttctgatgtgccccaggtggtgaaacctgtcaacaatgcatctaaaatgaatgagtcttcaaagaggaaggactccctacacagatgtgggaaacatgacactgattttttttttcagccatgctctttcatggatggcaacattatccatgaccaaccataaaacaggaatggtatcaaaaggcatcattgaccaaagcagcacatatgatccctcaatccacaggtaataaacccatcttattccttatttggccatccatcatatactccctgaacaatggcacttttttttttttctcatcctatcagtgttatctacattaagtccatttaaaagaaaatgctaggcatgttttagtgtagaggtagttccttttgatgaggatggcttctttctgcagacaaagctttatcaagaacctaatgaagcctaagctttggggccttttacttcccctagtgggagctttaccatgtgccgcaatcatttttgtttgtaaaattttcaaaaggaatatattttaaccacaataggtttgttgtactgtctctcaccattctgattttccttctgccacacttatcttcatatggctgcaggcaattttgaggtttagctaaaagggaatgataagttgagaatgcatttatttaggttagattgagcagtatatacttaaatagtttgcagtaatttccaagtatagctgttgctagtcatcctggtgtaggaataaatgggcttgcaagattacttgagatacctgcttcatgactcactgagtgttaggacgctaaggggcagggcctgagattttgccccaggttggatagctcctacagtgcattgcaccagaattgtgtgaatggggaaggtgaaggaaggcttgaaatagccaaaaacagatctgtggaaaagtattataagagatacattcggcagtcagtgattaataaagccattatgttatttttctggatttcatgtttgtgtttgtcaactttttgtaatttgtcacttgggtgattttttttctcatcttaaatgaatgttcatcttcactcctaatttatttgtttttttttcttacagaatttttcctatttttaaaaaacattaagacttccaaaacacggattgtcccttctacagccttatcaattctctttaatttgttaaattttgacaagtcctcttggtcctaatgtatgaaaatgtcatataaagtttaatgtcatttggtggttgttattagtaatttcactgctctcaacaacttctaaaaacatacagatattagataactagtccttatcaagtctctaagtgcaagaaaaaaataacactagcattccttttttttttttttccttcttgagacggagtctcattctgttgcctaggctagagtgcaatggcacgatgttggctcactgcaacctctgcctcccaggttcaagcgattcgcctgcctcagcgtcctgagtagctgggactacaggcacgtgccaccacaccaggctacttttttttgtatttttagtagagatggggtttcactatgttagccaggatggtcttgatctcctgaccccgtgatcctcccgcctcggcctcccaaagtgctgggattacaggcgtgagccactgcgcccggcctagcatcctatatttatagaataagtggagttgggcaatatgagtagattttcatagctcaaaagctctatgaattacccagcatttttgtctttttgccttctacatggggctatgcccttctacataaaacatattttttttcctaattatttgcagataatatgagagaattcctaaatgttatttttgctgaatgcctttattctacatatataatagatacttcggtgaaaaatgaatgttttggatagccacaatattctgaaattttctatgaggaaagatggtaataaagtgtttaagcatttctacttgaactagagttgactaattagaacaggtcaaagcatgtgcatttgtatacagaggataattttgtttggcatttccagtcatcaatctaactgcagtaatggatttagaagatatcagtaaagctttgaaaactgtagtgtgacaaataatacaagctcaccctttaaataaattgtaccaccaagaaatagagtgataataagttttgataaaagtaattcaaaactttccagatctagtgtaagccagttgtagagcctttgaaatctttggagttctgttttgaccacagataaatcactaatgtctggttcatttcaggatattttttaggatgaaggctataggataaatgaaagaaagcctctacattttactttactagtgaggaagtatttgcatttcctgtccttagagatgtaccaagtactcttaaggtgcacaaccccatgctaagtgtagacctttaccaaatcctttaagtcctttagagctcagtttccttattttatatgttttgagctccggcacaaatattctgtggtgttttgtctttattcatatattaagtgggtcagatccataatagagtagaagagtaattagcactctaggtataagagagtgctatgggaattgaagatatcactgaaacccttaggattccactgaattattatttaatacttgggaaagagttactagaggggataatcctggcttgaggtcagcaactccaaatctgggcattagaacagagtcacgcattattcaacaactctgtactaaggtctcaacgtaaaattaaatttgcatatggtcaaaattacctacctctctcctttatgaagtaagtctattgcagactgacatttttgtctttaactaatgtagtcagatttttcctcagtattgaataggtaactaactcttgagttcagcctctaataaaatagttgccttttgttttggggacatattacatatttttttaaaataaagtttatctttatatcattccaacggttttcctctctttttaattatttgcttatttatttacttatctatgtgttcatgctgagcttgtatattaagtttgtgtaagttaaatgtgcttatttgggcctggattccactgtgctttctaggtttactgctaatggtgaaggtttctctcaaccattcattactaaatcacactgctagagtggaccatttcggtgacatcatctttgtctcctattcttattttaccatttgagactgcaaaacctctaacttctaggccagttcctcaatgctttatcattgacaccacttgccattttcttctattttgggggggaaatttaaaaagtgatggctgcctttttaaaggttatatagatatttcattttctaattttatctcaaagattttaatctttaatatttttttctgagataaaaaggtattcaatgtcagggagggaaagatgtaaaataagttatttgaaatcatatttggtatgtacagaggaataaatacagacagattaagatctatagtgacacatcttatactgatttgtgcttccctataagagaatgtgtgtgcatcttaaaagacagagccaagatttctgttaagattaattgacatggagtggtttttctcttaataacttcaaagtaaagtttttttttctatttttggcataagtagagtaccctaactcaaacagaccaacatttcttgaacattaaataaagacaaattctgacatttttaaataatgagtacattatatgttccaacttagaaaatatttaaccttatttcaattattatgtttttggagcacttgaaaatgtaatctattaaaagttgccatgaagcctgtgggaaattagtctagtgatggttaatttgtttacctaaaccatacttgttttgaaaattatgaaacctaaatagtctatgtttaaagagaaacaaaccatttttaatgatttgaagtgtaattttttctccctcctttccaataatttattcctatgaggttgagaagaactaacttttattaaggaggatgtactttgttttgaactttttttttttttttttttgagagaggctggagtgcagtggcatgatcatagcttactgtaacctcaaactcctgggctcaaatgatcttcccactttgatctcccaaagcactgggattacaggcatgagccacctcacccagcctgttttgatttttgacaaaatgtgtcattgattaaactggaatcagatattttgctgttttctgttaccaagattagaattaccagtcattcccaaggatatgttttggactaggtgttaatgagtactgtacaaacagatgacaccttgcataaaacccagcctccagcatgtaggggcttgtagtaacgacagacatacagaattctaacacagagatggctttggcaaatgctagaatgaagtaaaacagttaagttgaaggagaggaaagaaaaacagaggcaaccgtgatgaagactgagaaagaaaaaggatatgaatgggacgttgatacagcttcaggaatagaatgagataaaaattaggacaaaggctgtagtcaaaacatggaatacattgaatactaacctgagggatttagactttactctcaatacctgaaatcgaatggtaatatgaaggaacacttgtagagatataatagagtagcaaaactctaatatggattggatttttatggacccacaaaaatcagaactctattatggaagggtccataaaaatccaatccattattttacagataaggaaactgaggcacagaagtgacttttggaagtgacttaccaaaggttgcatacaatatcagtagcttagagggaccaaaaacccaagtctgctgacttctagcctagaaatctttcgatcacattaggctatattgggctattcaaggtcaaagtcctcagcagttattacatcttgaatatgttgatataggcctagttgtcattgttttttagtatctgttcttctcctacgggcttctaagaatgagaatcttctggacgtatgaatgtggtatgtatgctaatatatttgcccttcatataaaaattcttataattccctttttagaaaattgttgactcactccatgacttgtggaaggtggtacgttttgttcatgtgaacttgacagtttcttgtaacatttattctctagaaattggcttttctatctactctgggagttattttagttcttggtttcccgcattcatagatggctgattcggataatatttatgtccacaatatggacctaaaattcacaaaaattaaatgtattcatttagaatacttgtgagtgatattttcctccataagctattttggctggtgtgctaggtcaggtatacatgccaatgatttcagaagtaagtcttataggtgtttattatgaattcaatgtttatgaaaagtgatatcattagcaatgcacattgttaggaactgaaaatatgtattttgaagtaattcttttgatatgaaattcttcttgaccatatggggcttcccccagtcttagatgtatgttccaatggaataaatattgaatgcttgtcttgtaaggcataatttgaaaaatattaaggcctttatattgagaatacaaattttgttgagcagtgcttcaactgccagcaggattggcaaaacagctttaggcaaaagcagtgtctactacagttagctattttatatgttgtccacacatatttggtataattatatatgtttgtatgtgtatacatgtggataaaattttccattctgagccctatgaaaggtagttttgatcattagtagtagtagttaacagagactctctgccttgaacattacaagggcatgcttgatatttcctggataataagcaaggtcatcagaagaaactgtggtttctataatccttgtcttggtaaggtcttgacagtaagagaccgagttacattttggaggcatcatacttctttggcatcaaagtgtttgctccaccatctctctctctctctctgtttctttcagtctttctctctctctctctctgtcacacacacacacatgcatgcacacacacacacacacacacgggaaaattcactctgcaggaaaggcagctgttaacttactgatgtttaggctattcaggctgtgctctgctaagctcagttgggtgccattcacaaaagaccccctaggatatggtgcctataattggaatggtgccttctggggctctgcagtgcccttcaagagcaggacatatcttaaaatgtttccaaaagattttcaataacaggaaaaaacacccatatacattagatctatgatttgtatacaattctgcagatccacaatttcccagtctcttatctctgacttgtccactagacctcaagacttagggtctatttttggagccgtgtcccaagtcttcacctggattcttcactggactccttttgcctggataggtccagtgacactttcaaatcattgcaatcactggaatttattgtttatactcaggcataaatatgggaaatatcactgttactctctagagccaacattactctttgggcacctcagtctgggtttccttctaatcttgaaaaccagacaagacatctgctcccctctgtgctttcttctttagcaactctgttgtccttaatccctcctttcactcatttctttccacctggggccaagttgctattttccatagtgttactaatctgtacatctaatgagccagtattttatcctattctgatatgtcagagaagggggatgattgggagtaagatagtatacatgacacttttctctattgagaacttttattcctcgaggtgacccgttgtctagattgaagatcaacatatacaagagaactcaagaattcccaacatcactatggattatatttgaatatcattgctttatttctgtgaaagtgttctcagtccagagcttgagaaggagtatacacacgcagagggacacataggttacaaatgatacaaagatataagacatatcagctacctatggcctatgaagaataagaaaatgagtttaatgtaaaacaaaagtaaccagaatttttgaacatcttgtttatgctatagattcagggaaacactcagtatctgttatgcaccatgtggtcgcagcaattgtgaagtatagataatgttgtaggcccagtgagcggcaacaagggtcaaagtcggtggtcatgatttggttgcaagtctgtctgacttcaaggatcttgtgtttccactatacatgatgcctgtgaaaagatgtttccaggggaaaggaaccacccttttggtggttatacatgtgctcttcatgtataatgttatgcactttcatgtattcctcactgagaccacataataatcatgtaagcgaggtataggttatcattcctacttagattccagagctgtgagaggaggctaatttgttcaggatcgcatgaccacaaaggcataaaccagaattggaatccaaacagtatgactctagggcagtaccctgtgcataccctgtgggccctacctgtctcacctcctgtttttttgaacaggtgagctaagaacaatagttatattaataaatgttcaaaagaatgatattattatttaatgacaataattgtttacatattttctgtggctgttttcgtactatgaatgttgagtatttgtgacagactatatggccttcagagcctaaaatatttagttgctggccttttacggaagaatttgctaatccctactctaaaatctacattcttagcctcagggctgttcttttttcacaagctcgtgccaggcttatattgagcacttttataatttgtggcttattttgtaacatatgagagttttaaaataaaaataaacatctgaaacattttggatgaatgtggcacagatgtgaaattttaggggcagctcagtaaaaccataaaatagattctataatgtattgtgggaaagcatgataaatgttttactcacagcattgctagttctgtgattcatttaaaaaatgtatctatgttgacaaataaaatgatgtttatttgtgtgttacgtcaccaatatatttagctaatttctatttatttgtattcatcaggttattttccaaagcagataaaaagtagaacattcactggaaacttatgaataaagctacatgcttaatggtttagctaataaggccagagaaaaaacaaatatgtctacctatgaaaaaaattgtatttaagacacctactatgtgctgtgcacttttataggaggtaactcattttactcttcaagactcagaagtaaaataaccactgcaagtcatgcagcgaagccggatcttggaactccaaatcagcatctttttgtaaaacattataggacatttataatttcaagttgtacattagtctagaattactcatccagctggacaatggattctgtttctatttatttgactctattacttctgtctgttattagttgttctaagtattacccattatttgactttattacttctgtctgtagtttactagatgttcaaaagtagctgaagatgtaaatgatattgccactacttcatatctcacaaaatagttgaagatgccctcttctcacagctccactaggtggtgccccagtagggactctgtggggtgctccaacaccacatttcccttccatgccctagcagaggttctccatgagtgccctacccctgcagcaagcttctgcctggccatccaggcatttccgtataccttctgaaatctaggtggaggttcccaaacctcaattcttgacttctgtgcactttcaagctcaacatcacatggaagctgccaaggctaggggcttgcaccctctgaagccagggcttgagatctacattggctcctttcagccactgctggatcagctggacacagggcaccaagtccgtaggctgcgcacagcatgcagaccccaggcccagcccaagaaacattttctcctaggcctctgggcctgtgatgggaggggctgtgacatgccctggagacattttcccctcctcatctccatctgagaccaccttatcttggaccttattgttcatatcactatcagcatttttgtcaaagcaatacaagtctctaggaagttccaaattttcccacattttcctgccttcttctgagccctccaaactgttccaacctctgcctgtaacccagttccaaagttgcctccatgttttcagttatcttttcagcaatgccccactctactggtaccaatttactgtattagtctattttcatgctgctgataaagacatacctgagactgggaagaaaaagaggtttaattggacttaacagttccacgtagctggggaggcctcagaatcatggcgaaggtgaaaggctcttcttacatggtggcggaaagagaaaatgaggaagttgcaaaaggggaaacccatgataaaaccatcagagctcatgagacttattcactatcacaataacagtatgggggaaactggccccatgattcagattatctcagggtaattatgggagtgggaattataggagtacagttcaacatgagatttggttggggacacagagccaaaccatatcagatgttaagcagaaagaacttgttttaataattcaaggtttcaataaatcttattccaagtttgtataaaagttggagagatgactttcttaatttccaaccactcactttttggtggttatctaaattttacagttgcaaacagtaaacatagaagtttaataaaatctaaataagcagcagactctttcatcttactcagaaccagatagcataaataccagacttgataatgagaaaagataaagatctgctactatgctatcttgaaagatagttttagatatttgtgataaatggttatagggaaaatgcatactgtgtcatcggttgcataataccaaagctgtaccttaaaaaactttgaaataggtattttttacattaaaacaaaatcagttatcatcagtaactctttatgtactgtaaacatttattgtgctcaagaaaaaacagatggtttgcacttaaaaaacttacaaactgaagaaaacaaggacagtgtgatttatgagtgtgtacttgtatatctttcataaggttccattcctggtgggcatgtaatttggcacaatgctttcgttcttcggaacgcaaatttgcaatatgtgccaagagttttggaaatgtccttaccatttgaatcaaaacttttaacttctaggaatttgccttaagaaagatgtaaaatgcgttcatcatcatgttagatatgaatgaaaaattttaaaaaatctgaacaaataagtataagaaaatggctaacatactatatccaattatgttactatagtatagtaactatagtatatccaaggtgtgggctattttgcaatcaataacatgatgttaaaaatgtatatctgctatcttgggggaacatattacattaactgaaaaagaagaactattttcttaaaaatttgatttattaatatataatatgcatatacacctctatacttctatgataacactgattaaaatgtactatgttttcctttttatttatgcatgttccccactacaccaaacaaatccaagggaaaggattgtgtcattcactagtgtagtgtccttattgtgcataatgctcggtatgttgtagataaactgtaacttcttttgagtaaataagaaagatgagagaaaatctggtggtctttgtataatggaattatactttttttacatttacattttatattttatttagtactttcttatttatataatcagaacagacaatttaaaaagtaatagtaaatttatatattgaaaaagagagatggcatcttttttccaaaactgctggcttaggtatatagtgttgaaatggttctttctaatttagctctagtttaaataaccctctcttaatgggccagcctacaagatcatatctgttgcatggcttcctttctaccccatggtattcttttacagaatgaagtatccaacagtgcaatgctgaatcattattagctctaatttgggaaatcgagccttgaagtaataagtgtttggggtctgattctgtgaatgctactcactctcagctttcctttcatcaaaggagcttgtcttcatttgcaaacatttcttttctcttcaaaacatctttcacagtgcctttgccaggtaaatacattccttcctgaaatattaaatcaatacatcaaattaattgccgcgagttttgagacctgacaccaaaagagaatacacagcctctagctcaattcagaggtcactatgctgaattgctttcacaatctttgaattatgcatttgaaatgtttgctgctgtatcttgattggaatgtattttttagtgtgaaaataattgacaggaattagtgtttttttccttttcaaagaaaaattcaggatcacatggaagcctcttgcatgattagcaaacaagacacaccttccagatttatttacttcaatcaatagattgcaaatgtcctaatgtaacttgaatacgtcatctgtgcttggttgccaagaagataatctgactcttggttttatttcctcaaccatatccttcactgagaatctggagaaaatccctcaacattttcatcaaagggatgtttgatgtagaaaatcttagctacaagaaaaccaaggatccaatacaataaaggagagtttctatttgcacgtgttatgaaacttcagcccactgttttcttacctagctaatcttatgctttaatgtccaagcttgtatagaattcaaaaagtgatcaggaattagcctataggatgcttttgtaaaaattagaaaaaggtactcctggtggacaaatcagttaggaaaaagaatctccttgagtggatcctggggtgcaaggttagtcactggcacactgtttcccgtttggcttagattctttgtgaaatgcacaaatgcccaacctgggatagcagctcttgggtaaaggatgagtgtatgagaattgtatgaagcatctgagaggtatggtatgaaagatgccctgtagcacctgggaacacatccaaatctcaattggcatgggtcacgtgtagctacaggtctcagaaatagttcttggccatttcagagaatactattcatgctgttgccaaattcaaagcatgaggaacagctgatttttatatattgctgatgtttgacacataaaatggcaattttctatgattcaacctaaataagtcccctattagtagtgcttggccattttctaatgttttgattaaaatgctacttgtctcttatccctacacctcaatgtcttgatattcctccccccccccaccccactacataaattgagctgttatcttaaatggcagccatctctgtctggagctgttaattcttgatactgttgaaaataactttgatttgatcttattgctactgtcagcacactgagtgggtgccagtttcaggacacaatagtaggtgagggactttttaatcagtgaaaagtttgtagcagaagagtcactagtattatttgttaaatctacctagaaacatgaaacaattggaataattactggacaaatattttacaaaaatgcatgtagtgtttttataggttataatgcttacagtgagcttcaagaaactctagaacttatgcttctgtgctttgctgctttgtttattatagggaaagaaaagaagataggaaggaaggaaagaagttaaatattctttcatgaatggataaactgttagagtttatcctacagttgagtagttcaattggagcaaatagatgtacagcagatccttgaataatattgtttcattcaagtcatttattataacattgatgagaaaaaaacatcagttcccagcctgggccactgtctgtgtggagttggcttgttctcttgtgtggattttctctgggtactctggtttcctctcacgtgtcaaagatgtacacgctaggtaattttgtgtctggaattggtgggttcttggtctcactgacttcaagaatgaagccatggaccctcgcggtgagtgttacagttcttaaaggcggcgtgtctggagtttgttccttctgatgttcggatgtgttcggagtttctgctttctggtgggttcgtggtctcactggctcaggagtgaagctgcagaccttcgcggtgagtgttaaagctcataaaggcagtgtggagccaaagagtgagcagcagcaagatttattgcaaagagcaaaagaacaaagcttccacagtgtggaaggggaccccagcaggttgccactgctggcaccggcagcctgcttttattctcttatctggccccactcacatcctgctgattggtagggcccagtggtctgttttgacagggcgctgtttggtgcgttcacaatccctgcgctagacacaaaggttctccacgtccctaccagactcaggagcccagctggcttcacttagtggatcccgcaccggggctgcaggtggagctgcctgccagtcccgcgctgtgggccggcactcctcaggccttgggtggtccatgggactgggcgccgttgagcagggggcgccgctcgtggggaggctccggccgcacaggagcccacggagttggggggaggctcaggcatggcaggctgcaggtcccgagccctgccccgcgagaagccagctaaggccctgcgagaaattgagcacagcagctgctggctcaggtgctaagcccctcactgccccaggcgggtggggctggccggccaatccgagtgcggggtccgcgagccctcgcccacgcggaactcccgctggcccgcaagcaccgtccgcaggcccggttcccgcccgcgcttctccgagctccacaccttcccgcaagctgagggagccggctcccggccttgggcagcccagaaaggggctccacagtgcagcggcgggctgaagggctcctcaagtgccgccaaagtaggagcccaggcagaggaggcgcggagagcgagagagggccgtgagcactgccagcacgctgtcaccgctgaatttgacctgcgtacatgatcccagtctgagtgagtgtgggtgggtgtgaatgcaccctgcaatagaatgatgtcctgtccagcgtgggtttctgccttgcaccctgaacttctgggataggctctggccactctgtgacactgaactgaagtagctgggtaaataattatcttacttgtttttattaaactttgttaaatgtatgtatagttcgcgcttatctcagtgtttagtattagaagtgttttggtttttatttagaagtttggtgacgttaggagaaatgtgccataggaacttaactcttgtttgtatcaattagcctatggtaaaattggttttattataccttgctttgcttaaagtcacagcttccaaaaacctatcaatgacattaggtgagacttactatatagttatcaatgtgatagatttcaaaaacaaagttcatcgggagggggtaacttcaaaataatccatatagaatgatacaatttatgtaaattttacaagcacataaaagatttttaaatgctgtttatatacacaaaaatatgatgaaagtataaaacaaaggtgattagattacatgtgcactccagaattatgtgtgcctctggggcatacatatgtatcttctggggaaagatgagagggactaaaattgaggaagcaatgttggctgcatctggaatattatcaaattagaaacaaatacggaaatatggttaatattttttaattctggacgataggccctgaattttggtcacattactctcttcaatttttatgtctgaatacttaagaataacgatataacaatgatcatctatgtaagtctgttttacgtggaaaatttaaatactaacaaattagtggatttttcttaaaaaatgcagatgctgttatctttttaatgccatcagagggtctcaggcacttcaaattcacagagttacagcgatctaaggttctgagtgaaagacatcctagttgaaatgacttgattttcttaagcaattattttagaaaaatggccaaaattgaaatcaggaaaactgactttcagcatagatttgattatccttacttggaaaacagccattgtgcatttgtttgataaaacagatttcaacatagggccttgtagttagagataatttttacataatgtcatcgaataaatgatagttttatgtataattctgtgtaactgtgtgtatatagtttatgagatgggggaaggcaggcaaaagcttggtggcatagtcttagacctttaaatagtatataaaaggctctgcagattccctagagggatttgcaactccattgctccacagtaccaataagcagtgcagaataccagggctgaaagaaacttcattgaagttgttagtctctctttgaatcctggaagaagtcttcatttgagtctttgaagaagtcttcatctgagtcttcctccgtgtgggggtgggtacatgcagctttttggttaacaacagagacaacaaaaatgtggacagtcattatctagataaattatacactatctcttctcttcttacgtcatcgtgtactgcctcccttctccagcctgttaatatgcttaagatgaaggactccagtgtctttcacggggagggaagtaagaaggaaaaccctggtatgtacactgcgtggtgtatgcttttgagagttgaaggtggagtaagagggcactggttaaaatcttataatttgttattcttgtagtattaggtagaactgtgacactctaaccattttatatgccctttcctcagaatctggtaaaggaagatgtggtataagtttaagatgaaacaaagcataaaattattcactcaagttgcagccttagaatggtatagattccattaatagacatccatgtagaacatgtgtaaatgaagatatctaagacaaggaaaaaaaaagccaaaggagtagattttaaacacagaaattattaacacctttctgtaatactctaggtttcaacatcctatgtgccatacatatattatgctaaaatattttaatgccattgtcaaaaacatcagttggtttaaaaacccagttgaacttgactttattattctgttttgacctaattcctttggaagtcacttagtttatttatatgttaatgttttatctgtagtataaaatggtatgagattgtgggaggtaaatacagttcttatggccaaattaaatggcaatacatgttaatgcagcaacaaacagcataagcttttttgctttgttttctttttgaacttagtatttataaatcccctaggaagaaccacttgataggaggtcacaggtagcatctgtagatgtttttaattggtgttttcgttgttgagtaatggaagagtcttcagatattattcagtcagtctgttgttctcagagctgcccatggcctctgtgggaattagacaaaggcatctttcctccagtggacatggcccaatgctagggctcatggcttggtgaacgaatgcaggctggatttcagtcctcatagagccctttagctgggcactcttgttcaaaatatgacctactcaaatgtttgtggcagccctggtggttgttctccaaaagctgtgctggtttataaaaccctctccttcacattagtacaaggaatacatacctgagtattaaagggcaactgcagtgggcacatgcattgaatattagtgtgttccttgagttcagtgatttacagtaatctgtacagaggcaaacacaaatgaataattagggtcatgtaaatgtagacaatgaagaccctgtaatttacagactgaacttggagcaagtgaaaatagcaagactgagaaatctgtgcagttagtatattagctctgattcactaaagtacatgaaccactgagggacccagaacagaatcaaaggctaatgtatatgcagggcacacatgtgcacaaacgtgtgtatgtcttttgtttcaaagcaatttttatccaaattacatatccattgcttaagaaaaaaatgcgattaaaggtccattttgaaactattggataagggataaatatatttatataaaatttacatatgtcctataaattttatggtaagatatttagcagttggatttggagtatatttcaaaataaagatcttcagaattcagggcttgtgggggacacaattcaaaaagcatggcaagataatttcttagatttttcaaatggcgtcagaagtcatctaggctgtttctgcacctcatggtagtctgctttctgttgcacttgtgcaagtcatccatcttagtattagttcttttggtaacagcgagatcaccgtatttaaggtagcttgtgaccttttggatagccttagttactagacagagttatgttcatgctgagattaaatctttcccttgtaatgtccatcagtgggctctgcttctgtttcctggacaaacctagaataagagtgctctctcttctatgtgacaatgctgcagatatatgaaatggtataatttccctgtctcaagactgagaaaatagtagactagacaatggtaaaacaaactgaaaaagaaaaaaatatccaggaagtagagagattattccaagtctttgtttttgcagacacttgcacccctttatgagaatttatttgcatagaataataactttttatgatttaataaccgcatgctgaggaaatacattttgctttccaaattgtggatgaataacaatgccagaagaccttttacaaaggcaaaagaaccaattacttgtcctccttgtttctaatattgtagtctcatataaagtagaccgaaaaaaataaagcttactgtgatgttacttcttagcatatgttggcatatgtttatatcataaaatacacattttgggtctttttcctcaatgagcttttgttgaaaattatagaatttggtacaagtcttcaagatcatttggaaccaagtgtctagcagtgagcaggagaagcgtatcttacagttttttaattccagaggatgttccaaaatagtagctttaatttttactcacactaaaattttaaaggagcaaacctagaaagttcccagaaaacgtatgtaattattagaatacaggactaactaagtaatttttgatatattgattcttacatcacgattcaaattgtagttataaagacaggaataaatagggaaatactgatgatactgtgtgtttcagttaggaatgctttcagcctaaaatacaagagaacccaagtatcagtggtttaaacaaataggactttttttttcacctaataaaacatctggctataggcttttgctggcctattttactattaaatgatattatcaaaaatccaggattttttccatcctttagttatgccatatccaggcatgtcacctcaaggtcacaagataactagtacagtcctggacaccacaatcacattaccaggcatggatgaggggcagaaaaggtagaagagcataatggcccggatggtgagaacatttctcttctcatagctctcttttaatagaaatgaaaatcttttaacctagatactttcaaactgacttatccaaatatctcattggacaggacttgttaacttggccacataatggcaagtgaaaatatcagtttcacaattatggctatgctatgataatatttatttaaaatattaatggagaaaaattttagaaactagtctagaattattaccagtagctgaggaaagtagaatgatggaatctatctatctatctatctatctatctatctatctatctatctatctacctacctacctatctatctaagctgtctatctaatctagtttcctaatgctttataatgtggctaccttagttagataactaaatcatgcatttataataaaattaaatttatttaaccttaaagatattagccttctacttgacagattcattggtttatcaagtatctcatttgacatcacatccacacagctatacttaaccaaagcagggaacggagcagggaagccatgctggtatctttatgatcatccttttagctagagcatattcagtatcacaaccaatgccttccccagtgttcgtggactcaaaacatgattatattgatttctttaaaaatctatactgcagatcatatttaaacataaaatatacttagtattggcgtggaaacattgtgattagtttcatctaatttcatgagctctctctttactcactttccgctttcttggctactcttttcaggctcatttgatggtttctcctgatttttttcaacctttgacagtttaagttttctggattcagtattcagactttatttttgctctgtttttacttactttctaaattatccaatttctgctaactccaaatttctatctaagcatagctatcatccttaaacttcagaaattaggccaggcgcagtggctcatgcctgtaatcccatcactttgggaggccgaggtgagcggatcgcctgaggtcgggagttcaagaggagcctgaccaacatggagaaaccctgtctctactaaaaatacaaaattagccaggcatggtggcgcatgcctgtaatcccaggtactctagaggctgaggcaggagaatcgcttgaacctgggaggcggaggttgcggtgagccgagatcgtgccactgtactccagcctgggcaacaagagcgaaactctgtctaaaaaaaaaaaaaaaacaaaaaaaacttcggaatctattcaactgcatactttatatctcctcttggatgcttaatagacttcttaaacagcatatataagaccaaactgtcaaaatcacccagacctgcagagtttttgttccatctcataagatacacctctgcctttctagttattaaggcaaaagcattgacatcattcttgaactccttttttttccctctccaactgcagtggaatccataggcaaatttttcagctcttctaaaaatgcctcagatatgaccacttctcaccaccttcattggtatcgctctggtccaaaatcacctcatgtttttttatggactgtcatgataaccctctactagtcttcccagtctggctcttgttcttctatagcctatcctattttgttaagtggaagaaatttagggtttgagatatttcacactaattaagatacctctgctgtatcttaatattcaagctgttttccttttgtctgtttgcgtttgtctttttctttctttcctctctccctctcttcttttcttccttcctttcattctgaagattaaaactgtatgcagtttttacattgttcattatagtcattaagttctagtcactgttcatacataacttctgtatccataattcattgactcaccacctgtctgagatagaaaggatcttggagatcatacgattcaactacttcaccttacacatgagacaggtaaggtccagagaggagaggtgacttgagcatgatcatacagttttttattgattgaattgaaacccaattctaagatacctcatgtgtagactagtgtttttccaaagtagaaaatatctactagatatagtatatctaacatgtaaacctcctcatgacttaggtctaaaaggtgctcaacccaaaatctaatcatcaacagaaatgagttttctcatgaaaagacaattttgtaaattgcagattaggtggcttccatggtgtcatatcaacataactcagatgtattgacaacattgccttggaaaaatgtgtgtgtgtatgtgtgtctcaggtaatattcagttataaaaatacacacacagacacacacacacacacacacacacacacatgcttgatagaagagaaaccattcctgatggagaaagtatacagttgagtgtgcattaataattttgtgtataaggggctcaggtatgtgtggctaacaaatcacaaataactacaatattgaacgttgtaatagtcttaattaaaaaataggccatgatgatagagaatagttgagagagggatctacttagagaagatgatcagggaaggactctgagaagtgtacatttaatccaagacctgaaatatgtaaaacagggagaagaaactacacgggcaaaagccttgaaagtggaaagagctgggaagaacattcttgagtataaaataccaggtgtgaggagtgagtgaagttttaggcagggtattccaggccatgaaagaggtagtttagatctcattccaagtgcaatggaaaatctttaaagaatttaaaacaggagggtgatagtgtgatttttctgcaaagatttctaggtagtataaccaaaagcaggtgttaaatccacatgtggattaggttagcaccattccacggtcataccattgacatcactaactaatgaaagagtgagatccccatcactagggtactggtgcagaggaggctgggcaaccactttatgagaatatgatagagggggattaaaggattataggttgggcatgaggttatgtattgacctttatgatcctctccaaactttaagcttccatagttctatgaactaagctaattattgaaaatgtctttaggaataaaagaaaaccataagatcaaaggggttattattcagaagggaattccccctctccccctaaaccatagaaatcaattatatacttatctagaaaggtgttatcccccttcccacactggagctgcggaatataatctgaacccccttccattagagcagaaggtcttaattttttgtgtgatatctctcactgagtaatcttgtttaaaatgaaggtcaccaggtcctataccttggaggttctgcttcagtagacctgaggtaaggtttatgaaactgcaaatgtaataagcaacccaggagattccaatagatgaggtggatgaagtgaacaaggactgtactttgagaaaccgtgggtttggtgacaacaaaagaaaaaacaaaacaaaacccatttagatcctagctgtagttcacctctagccatcctccactgaactcaggagtattacagctctaaggatggtttaacttgctgtttagcattgttaggttatgcaacctttctgagccaaagtttcttcatctataatgacacttaccgtaagatgctattgtgagggccacagattcaaaatacagaatgctgacctgagcgtctggcgtatcacagctgcttaataaacaaaagctattatctgctttatttcagcctaatttatttggcttccttcttactactcatctccattctgtaatgcagagtcagcatacacctgtgttggtttgtttctcaattattgtcttcttcttgcctcgacctctcttgcagactcccagagacttgccttaagcaagtatcaccttaattaaagtttgttttttccatctctgcattattataatgactctagaagaaaactccgatattacagccatggaatagctgtgaccatcaaattagtttagtcttatgtttcctgttacttaacttacaattatctcttgtaaagctactcatctttcctgtttaatctaacatgagtactgcaaagcagagaatacagttcaggagacagatgaggttttggaaaatgctaccaaattatggaaaacatttgaataccactagcttttgcagaatataaacaaaacttaaatggagaaaggtcagtccactctgatggattgggcatattaatttgtatatgttgtcttcaaaaattcaaatttaaaagacctatcagtgtaaaggtaataaaacgactaaaacatgactgaattaaccatttttttcctcaaatcttcatgtatgcttgaagtaaaaaggctgttccagtcagtttgaaattaaaaagaaatattctttgaattaaatataattgcaagtaaagtctagactgtgcttctggagaatcaggggacaagttaaattaaatattttgggaatcttagtattcttagaatatggctggtttcatttgctagattccacttaacttgcctttcagtaggccaaataagatgtcaagataaataactgtgttttttgaataaaaaatattgtcttgtggtcttactttgtttttaaataaacttctaaaagaagttttttaaaaggtataaaattaaaaccacacttagctgcataaacttatgtttatttaaaagaataaaattatactaaatgaaaattgtcccagaaaatccaggccctgtcactttctccttaactcttcacctttccttttcctctgggatgggaagtcacaatttttatctactattcatttctgtatgttgaaagggggaagctatggcaaagaataagctttgcaaaggcaggagaaaagtttgaccacattttatttacgcagtctaccatagatgggcccctaggttgattccatgtctttgctattgtgcatagcactgtggtgaacatatgagtgcacgtgtttttgtttttgttttttgttgttgttgttgttgttataatgatctattttcctttgtgtatatacccagtaatgggattgctgggttgaatggtagttctgttttatattctttgagaaatctccaaactgctttccacagtggctgaactaatctacattccaaccaacaatgtataagcattcccttttcttcacagcttcaccagcatctgttgttatttgactttttaataatagccattctgatcggtatgagatggtatctcgttgtgggttttgatttgcatttctcagatgattagtgatgatgaatattttttcatatttttattggccacttgcatgtcttcttttgagaagtgtctgttcatgtcctttgcccatttgtaatagggtttttttttgtttgttggtttgttgaagtttcacatagattctagatattagatctttgtcagatgcatagtttgcaaatagcttctttcattctgcaggttgtctgtttacagtttattttgctatggaaaagctttttagtttaattacatcccacttgtcagtttttatttttgttgtaattccttttgtggacttagccagaaattctttgccaaggccaatattgagaaggctattccctaagttttcttcaggatttttatagtttgaagtcttacatttaaatcttgaatccaacttgagttaacttttgtatatggtgactggtaggggtacaatttctttcttctgcatatggctaaccagttatcttagcaccatttattaaataggggagtcccttccccattgcttgcttttgttgttcttgtaaaatatcatatggttgtaaatgtgtggctttatttctgagttttctattctgttccattggtctatgtgtctgtttttgtaccagtaccacgctgttttggttactatagccttatagcatactttgaagttgggtaatgtgatgcctctggctttgttctttatgcttaagattattttggctatttgagctatattttgtttccatacgaattttagaatattttattctaattctgtgaaggatgatgttggtattttcatcagaatagtgttgaatctgtaaattctttttgatggtatggacagatactgatttttcaatccatgagcatggactgtttttacatttatttatatcatctctgatttctttcagccaaattttatggtagagattttttttaactctttagttagttgtattcatgggtattttattttctttgtggctattgtaaatgggattatgttcttgatttgactgtcagcctggacattggtgtatagaaatggtattcatttttgtacatctattttgtatccagaaaccatactgaaagtgtttatcagttctagcagccttttggcagagtctttagggttttctaggtatagagtaatatcattagcaaaggagatagtttgacttattttcccatttgaataactttttatttttctcttgcattatttttcaatatgaaacttatttattgaactctaagggacaataaacctgacaagaattagtacaattcaacactaaagctcatataggtggaaaagtgaaatttacaaaatttattgatgattttgctaattctaaattatgaaagtatataaatttgcttcaagtttgtttatcttaatgagctttcacctttgtttaatgaaagttttaaaatttgttaatatagggtttttccttcaataagattgctgtttttaaaattaaattatttttattaaaccattcaaatgaatgattaaataactttaagaagtttttttgttgttgttgtttttttttttttttttttttttgatggagtctcgctctgtcgccaggctggagtgcagtggtgcgatatcggctcactgcaccctctgcctcccaggttcaagcgattctcctgcctcagcctcccgagtagctgggactacaggcacgtgccaccatgcccagctaatttttgtatttttagtagagatggggtttcaccatgttggccaggatggtctcgatctcttgacctcatgatccgcctgactcggcctcccaaagtgctgggattacaggcgtgagtcaccacgcccagccaagaagatatttttgagtatgtattacatgcatataacagaaaattcaaaagttaaaatgggtatacaatgaaaataagtctctcttatttttttatcctcagccgcatactccttcaatcatttactgtcactaggttcttgtagatctttccagtgctattctaaagaatcatctcaaactttaatgtgtatatgaatcttgttaaaatgtgggttaagtttcactgggtctggagtgaaacttaagattatgaatttccacctgagggtgatgttgctggcccacgactatgcacccaatggcaaggttgtgaaggacatttgtttccatttgtctctctgtttgtttgtttattggactgaagggagcaagatagtctcataaacagatgcggttttctgctttctactactacctcagcactagagttccagctttgagctttgcactgttacaaagctttcttctaatctttgtcttaagtgataatctatacagtatttaaaaaatcaaaccataaatgaagaatgaaacctagcaatatgaagcctgatactggatgatgtataaattacaaggactatgagaaatcttttttacaaatttttaatctgctatttaaacaaggttagaaaagttaccaaataaagataacctcctaaattttggcagaagtcatgctgtaaactttagcttggagccagtactattaatctaataaagatgctatcatacttggaaatgatgcagttaagctccctgaaatcaatataaagtgcaaagatcatttaaatattttaaagtcataaatattaatattctatcttcctatacaaagtagtttccagaaatgactgtgttcaatatcacaagggatacaaacgttgtctttgttgaacctgcatgtaaaggtaattctgaaagcataggggggcaactcacaaaacaatgtcaaaagttcctgtttgtttcttgctctgtgcaggaaagtgaaggatggaggacttatatttgtctaccttccttgtcaacagcatatgttactatgagtacttgctaacccaatgcaaggattctttttaaaaagagaaccaatatcaaagatactcttcagaaataaagatttgaactataaatgtctcaatttctgcataattggcaggaagagccaagagaatacaggtttctgtatgatgccaagtcagtgtgtatcagtgaccccattgctttgaatggctccagggatctgccatatggagaattattacactcggtgctgagatggttatttttaaatatttgaggctacaaagggagaatggtttgtatctgcctaatcttcttgagcatacactattctacttagagttgtgattctcaaacctaaattatgtagtagtatactaaatgatatgcacaagtcatagtagaaacagcacaacctttcaaagtttcaattgaattaaaagttttacaggcccatatcaaaacaaaataacactacaacaagcaataatatatgaaagggtataatgaaaaattctgatgaatttttaagttaaacctaagatttgaaaacaatatcaggcttagggatatgcttctaggccccatggaatacaaatttgttggccagtagaaggatatttcagtgggaaacttttaagtattgcaaaatacattaaaagcacgtgagattagagaccagattatttgagtagaaacgacatttctgtgctgcctatgagactccagagtggctgtatgcaaaacattttgagaccacagaagttactgtcctatttctgaaacactgattttctgcatgaaattagaaagtgacatagagtttgctaacacatccagactggcttaggagatgtcatcaatgaatttttaatgtataatctctagagagaaaaatccatgtctttgggttttttggagactgaaataggtaaaaatattttttctacaatttacccatttctcctgctagtagcgagcaagtcagttctttacagaatgtgtggtatagtaaaataagtcacatagactgagttttaatctccagcattggatcttagacaggaaactaaagttctctaggtctgtgttctctgaaaagtgggacaagtacaaagatgaaagaagctaatagtggatcaatgtttatgctcttctctcttttttattttcatcttttatacctttccattcctacccgcattctctttgggcttaagaagttaacaataaacagtacatcttcatttgaaggggaaagtggtgctccatattaggagatcagactcagtgacctgggtgtttaccaatcatgagattctctctgaagattcatgaaagcttcttgctaagaaagcatttagagaaatagtcagctgcctagtgtataagtacatttatatcttactgtttactctcactttcaaactgaatatatatataaaaattacctagaaacaagcagagaaaagccatgtggcatttagatgcatattgcatatgcataattgatttcttaaaaggttaaatacccttagcatatgtatggatagtgatatacccatgatgatttcgtaagtattatggcagtggctttgttttacataattctaaagtaaatgtcatgtttcttctttagggattccaggactgggattcagaaaagcatgtgtttccaagtagatagctgggcaagagaggctactctcccaaatacagggaccattcatgtagctagtacactgagctttatgaagctcagactgccactaaatcctctttagaattgaaatgcaattacacatcgaggacaagtgctaaatataaacagaaaagaccaaatacgtgcctttattttttcctttgtttttgcagtatatttgcagaaagaattaaccacctcaaacacactataatccttaattgaaacacacagatcagtcaactcagtgaatccttcagcatcttttgtcaaaagtttattgtagctctgagggactggtcttttcttatattcataaacaattataaagatgctaaggaaattaataaatgaagcaagtaactaagaaatataccaaatgaagcatcattaaatatgtcctaaatatttaaaaataggcactatgttgcttgaggatacataaggggtgaaaactacataaatgtgagtgattattacaaaaattcaagttatgggcttcttctttgggaaaggaaggaaatacaatttgtatggtatacccaggggttttcactgcatgaatgatctacaggtatttattattgtttaataatattatatagtctttatggggtatcctatatttcctaatttttaaaaatggcaaaggcaagctgggtatggtgtctcatgcctgtaaacccagcaaggccaaggtgagtgaaccacttcagttcaggattcaagaccaggctacgcaacatgacaaaaccccatctctacaaaaattagccaggtgtgaatttttaacgtataatctctacagagaaaaatctgtgtggtagtgtgtgcctttaatcccagctactctagtggctgaggtgggaggatcacttgagcccaagaagttgaggctgcagcgagctgtgattgtgtcactgcactccagcctttctttcaaaaaaagaaaaaaaaatagaaaagacaaaatgacaaaacatagtgaagagaatgcaaaaattaagttggtaaaaaacccaatgtaatatacttataataataaaagtaaatatatcaatcttaggttgaagaatgtatttttctattacacttaaaataaaacttgatatatgccatgtgcaagataatactaaaacataagtccctgaaagtaggaatatgggaaaatatatgctagacaaatactaacaaagaaagctattgtatctatatagtttaagaactggactttaggataaaatgaaatgtttattctgcctgcaattcttgtttccgtattcattttctgagcctacttcatccaagcatctgcttctaacattctaggacttatgatagaccatctcgatctatttttgtcttattccaacctaaccatttcaaagcccagatgtttgatctctcagctctagtagtacctattatttgtggaccactgatttggtacttatatgatgtgttttagtgttatttatgtacatgtatttctttaattaaattacaatatcttagagctagagatcatgcttattcttctttaaatacctcctgtcacctcactctaggacttgccatctggtaaaattgtgttacctggcattatcatataatagaaagttaataaacatgtcagcagtcaactgaaaaatggcttctgaaagtgcattaaaagctttttttaggatgtgtagtactttgtcaatcctatgtatttacattttctaaataatcttccagccaaaattacaaaatggagttggggagagacacacactattgttaaagtgacccaaagctgtgccgagttgatgagactgagaccacaaccccagtaggagggtgcccccctctggagactcccacaggtttatgactatgcgatcgttaaggactgggaccacatctaatgaactttttgcatccacacctgaaacaaagtccaacatacaatgtgtagtcaataagtgattctgcaaagtgtgagagaattaattatgagtctagggtaatgcacctcactcctgtggcctcaaaacaatgtataattggagtttctcggtgtgtgtctctagctcatgctttcagagggggagagtggctgggaaggcagaagagccagctgggcagaggcagggtgctgatgcttacattacacttggtactctggggttaggcgctgattggagcaaagctgagtagtgtggattttgttctgccagccgatggtggactatgtttggaaacaaacaacaaaagcttaaaaggagatggagaaacacatggaatagattttcagtgcttctcctgctggccatcaagaagtagctggagtaccttctttcccatggcaggaaagatagtctgtctgctgcaaacctcatttaaacttactgttttttgaataggcaatatataaagcatgtgggataaaattcaaaaggtatagtagggtatatgggaaaaataagtgttttcccacctctgcctatagttgctctctctagagacaacacaattaccagattccatttatttttaggtatacaaaaacatttcatgtttggtatgcatacacatgtgcatatatatgtatttatttcagataaatagctcatataataacatactatactgaatcttgctttttaacaaattaacagcttatcctgtagttttttcatttttatctttatctttaaaatcccagtctctaacactgttggtataccaagtgtccaacatttgtttcttgtatgaatgaatgattaatttgatagtagtatctaattcattcatagtgaacctaaaagtcacccaccaacacattttttgaatgccttatcttaaaccccatctccaacatgcatcttttttctctctgtcgacattatattcaaattaaatctcaaaaaatttatcccatggaaaccttctctgaatattgactgtctctcccccaggagttatttctaagcacttaataatagtttaatgttactaattacttaataatttactattttgattgtcctctaagtcttttgtgttaatattacaaccataaatacgtgaatagcactctttttttttttctttttgagacggagtttcgctcttgttgcccaggctggagtgcagtggtgcgatcttgactcactgcaaccttcgccttctagtttcaagtgattctcctgtctcagcctcctgagtagctgggattacaggggcccaccaccatgccgggctaatttttgtattttcagtagggatggggtttcaccatattggccaggctggttttgaactcctgacctcgtgatccacccaccttggcctcccaaagtgctgtaattacaggcctgagccaccacacccagcctgaatagcactcttaacaataattttttattgagtagttgtttgtgccagacacttcactaagcacataatatgcataatctcattaattcctacaacacacctatgaagtaaataacattattattattgtagcatacctgtcattgcccagccaatatcacctagactcacctggagatcgtatccagaccatttccttatataccactgttttctggcatcttgctgccagagtgatctctggagagtgcacttagcttaagtgggtaggtcagaagtgtcaacatattgacatcccaggagtgaactttaaccaattatgtgtggacattagtggataaatacttctgctttctctcccctttgtgggacaacctttagttgtactcctcacaattatttcaggacccatgtattttgcccacagtggtgaacccctttttaacttaccctttattatcttttgtctcttccctatctcaatttactacttgctttcttcctggaatcacctcccaaataaactaattatgctcaaatcttagtctcagaatttgcttttggggaaagcagatttaaggaaattgaggtttagagttcttgagtaactttttcaaattcacctatacattacatggcagattcagtatatgaaaccagaagccatgatcaaaagcatcatcccttactgccaactagatggtaggtgccacaaagcagaccagtgaacatgtatgtttcttccacagtgtgtttcaaaatgcaagcctaagtcagaacttaatgcatacttctgctggtcaagtccattttatgttttggagtgtctcttttccactgcagcacatcagaatgtgccttttggcagctagctaaacacatatgctgataatttatacaggaattgtgtataaattctcacacttatctagttgctgagtatcttctccttgtttttctatagatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacggtgagttggctttctttcgtgctcactggagagtagtgagaggccgtcttctttcaacctagtaattgctccgcaactcccattaaggcttaatggcatttcacatacatgcaggctgttacagaagttccacaaatgacttggatgatagccttgttttaaccataagcagcataaactgcctagaaattttgaattagaattataactattcaatgtcaatgaatagttaacatatattaactgagttaatatatgttaaaataaagtacgttactattatattttggtaattcttaaaatatacgttatgtataatagttatttgtatattaataacttttatccaggagtatttctcaaattttatgcctttaaagaactacatctcaattccagtcattaaagacagagatctgtgtgttccctgcaaaaaaggaagtcagttaaaaaaaaaaattggcatatgcattttcttttccggttacctagccacagagcctttctcactatgctcttaaattctaaacacaaaacaggagacacttagcatctcatgttagagtaaattttcttgggctccaaactgcctctggggaaatactaggtcttttcttgtggctgcagttttgtgactctcttttgaatcaaagaggatctaggggtgtgtaaggtgtcctcagtccttgagttctatgtaggaatacatatcattagcaaatgggccctggtacttagggtaaatttaagagggagaaatgggagaaatgctagatcaaaaattagaacaaactattattttcctggtatccaaaattctcattttttcttcaatagctttccttttcccttgtagtaacataatcccctgagttttagctagtgcatggctaccaaactagaaaaaaatatttcccagcattctttgtaattaggttgggcttgtaactaagttttaggccaagatatatgagaaggagtattttgtgcaatctctgggtaaaataactgaaagtgaaattgttctctaatttatctcctttccctttcccatggtgtggacagaactgtgccctagaaagtaggtatattgacgtcataatccccaatatgattgtatttggagatagggcctttgaaaagataattagtgttaaataaggccataagggtggggacctaatccaatatgactagagtccttataggaagcagaagaggcactgagggtgtgcacacacaaaagaaagaccacatgaaaatacagcaggaaggcagctgtctgcaagtcaagaagagaggcctcaggagaaaccaaacctgtcagcaccgtgatcttagacatctaacttccagagctgtgataaaataaatttctatcgtttaagctacctagtccgtgttattttcttatggcagcctaagcaaactaatacgcatatattaagaagttaagacagcttaagatgcttctgggctgagacaatggggttttctagatataagatcatgtcatgtgcaaacagagacagtttgatgtcctcttttcctatttgaataccctgtattcctttctcttgcctgattgccctggccagaacttccaatattatgttgaataggagtggtaagagagagcatcctcgtcttgtgctggttttcaaggggaaatgcttcgttgataggtgcagcaaaccaccatggcacacgtttacctgtgtaacaaacctgcacatcctgcacatgtatcctggaagttaaaatgaaataaaattaaattaaaagaagaaaaggaattgtatatttgaaatagaaacaataatagctaagatgttgctaaagtttatttactggctctaaaaaaaaaagatagttccagttttatttgttgtaacaatattacaatgatgtttattctttcccttaaaaagaaaaagttaagacaaggctagaaaaccagtttcaaccatttgacaaggacaataacataatgaaatgcagagcaacaagatagaaggaacctgggtatgtttacagatccactttccactccagacaacaaaatttctatcttgttttgttgcatttctgtcttgtttgagtcacttattttggggtcttgtgtaacaatatttaaattgtactctaacacagggtttctcaaccttgccactgttgacattttgggtcagtaattcttgtggtagaaggctgtcctgtgcagtgtagatgcttagcagcatccctggcttctatatcttactcattactttgaggtattgagatcaatgtcaagaaggagaggctgcatatggaaatgtcatccccttttgtaagttatttttccttggaggatattccctgatgatgtggattttggatatatagtagttatgaagtattggagactatctctttgggacaggatacctcaaaacacagttcagaccattgtgtccttcccagtgtcaatacataaggcctacatagcaaatatgataaaacaaaaggattccagctctgtgtaattataccataatcattgaaaggaggcctgagataaaagaaaatgcaggatgttgctgagaatgcagactggcagggagtgacaaagctgccatccggtggaacgaaggggaaaggatttcctttgtctgaaatatccgctgactgcagacttgtccttcttaagataggcaccttgtgtaggtcactccaaatctatatgagtatttttctttttaagcctcttcacaatatccgaatctaggtgtcaggaccaaacaatggagacttataggcttgataggtagaaagtatggcgtacaggttgggagcaagaatttcttgagctcagttttttaatcagatgtctctgcagccttagacacacttgggtagaaatcattaaaggcaccagttccctttaagttagtcgccatggggaattgcctgacattctaagaaaactaattgatccagttacaagactgaaaattgccatctaccttaggctaatcatactgcattatagctatttatataaatatctgtctgcagatacagttgtgagcttttgaaggcacatttctacatccccagtgcctgacgcctggggtctcaaacagtgttcatcagatggtagtttcttagtaaatacttgctgaagggaattgaaattgattattagcctatgggtacttaaaaatatgtctggatttctggttttaaaaaatatgcttatgacttcaagtgtcctccttcctttcttcaaggatcattttcttttaatatgctttagaaagcagatgcttatcttatcctccccagatacattttgacattctgtgattgtgctgctttgcctatttgttccttaatgctatgattgctctcctgaccttacagaaaaagtgatatggaaaaagctatccaacacaatttctccatgcttcagagctataaaaccacatagtgggagatcatctctggttttccctattctttctcgttatccttcaagctgagatggacacactgagatgtcatgtcctatttgttttcttcctcactctagcttgttggctttaatatcaactttaatatcaactttaatatcaacaagttgtgtcttctctgatagcatgaaagaccatcatgattggatgtaccagccttagcttttatatgtttatcttaacatgtctatcctctctacagaaagcttatttttcaaacctatttgcatattagtaggtgcaatatcatcagtttcctggaaagaaaaacgtagagaacaaagatttaaggttgttcttagaataatattcccaattctgcaaaaaatattattgtgatgtattagtttgttagggttaccattataaagtaccacaaactgagtggcttaaacaacagaaatctgttatctcatagttccggaagctagtagttcctctagatgatagctgggttggtttcttctgaaggatgtgagaaagaatctctcccgtgcctctcactttgctgctggtggtttgctggaaacctttggtgatccttggcctgtagagtgtcacccagatctctgccttcatctttacatataggtctccctatgtgatggtctgtgtccaaattttcccttttaaatgagggtatcagtcacattggatttggtcctactctaatgacctccttttaacttgattacctctgtaaagaccctatcttcaaaaaaggtcccattttgaggtactggggattagactgcaacatatcttttggggaagataaaattcaacctaaaacatctagttacatttatgttgaatagattaggagttaagttatttgcccaagattacaaactagtaaataaaaaaccccgaatgcataaacattcttgcttgacttcaaggtccttgttcttaagccactgattctctgtggaggtggagatgctcccatctcccagggaagtttgcaaatctctggaggtttttgactcagtaattaggagaatgcttttgtcatttattgggcaagagtcagagttgctaaatatactgtaatgtgtggaatgatcttgcaattgaagaattgtccagtttcttgcatgactttctaatgcccagtcagactttccaggaggtgaaacactggattctaactacctgaatcctgaacttaacatgcagagtgctttttgaaaggatttatttcccactgaattttcaaaaataaaaccatagtgtaagtgagtgaagattgaactttatcacattcagaatttcaccatgtaagaaaatcttattagtggctcacagcacttgttggtctgatggagcacatattcaggtgttctgcactcagaggcgtagcatttgcagtgattctacatactggtccaattatgcaactgttttattatatcttctgctctagttggtcatacctgagcatttcttgttgagatatatattacagagtaaataacttcatttttattttctgtttctctctctctctctctctctctctctctctctctctctctctatatatatatatatatatatatatatatatatatctggaaataatgtgtataagtaggcaagttttgttatgatgatttttatttctaaatagtaaaaaaggaaatacaactatttattttaaaagagaatcttgagttttgataaggttgtggataactctgtactcacaaatgcattcattctcacgtcgccatcaaggtttgccatttctgtgtgtatacctcctgagctattgcttacttgatgtttttctttattctgattcactgtttcattttacttaaataaattgtaagcaaaagaaaactaagccactaccatgaatacaaaaccaggattactaacttcaaatagaaggcaaacataaataaatattaaatgaaaacatttgttttaagctttttttaaattagaaaagtaaaaagtatactgggtaataatagacctaatcaattttattatgccaaccagcatatatgttattttatttaattttcccagtaacccttcaaataaatatggattatctcctatttacagatgaggaaactgtgatgtagaaaaatgacttaaacacaggtctaaatgttatgtcatgaacaggtcccaatttgttgccccagtcattgtcccttattttatttacagattgatgcacttcaatttatttatttttacattttaaaatttaattatctgatgacatagtaaatgccccaaaaagcccaattctttttaatatgttaggttttcaattgtttgtgaaatggatatatggatacatacacacatatatatgtacatatatatatatatgcatatatgtatgtgtgtttacatacacacacacacacacttgttacagcaaaaataatttatttataattaactgcctttcttttttaagggagaatgcctccaaagggggaacctctatttacaagctggatatgtatgaagcaaatctcaaactgacctaagctgttgaataaatgaaaactgttgtgtggaaatagggagggctgaagaggcttctttagcattgggatgggtagaggaaaagaaggaagaactgtgaaagataggaagaaaagaggagaaaaggggagagagcaaaggaaacaaatggggaaacgtggtgatctcgtggtattttagccatcaacatgtctaaaggtaaatttgataatgctagctgcatattttagcttcaaatacacattttaactaatatgtacatattcaaatgtaagatatttatgttttccccttaaaataatcttgtgtaccattagaattattcataccactatttgggcaacacgctatgttcatgcaagtgtacacataagctgtctgaatcaggtatattcatattcagtcttatgatttcagatcctgataaaaaggaagcaaatttcttcatgaccttcctcttttacaatgagctattcatgacagataattacagtaagaaacattacttacttaaaaacatttttattgtgtatatttaatatatgtattactctataggatatatatatatatatatatatatatatatatatatatatatatatagtaaaatggttactgggtggaacaaattaacatatccattatctcacagagttacccacttccacccctgtggcaagagcagctgtaagctactcatttagcaaaaatcccaagtacaacacactattattaactatagtcttcttcttgttcattagatctttcaacttgttcatgctgcatatttgctgttttgtatcctttgaactgcatccccccaaatttttctccccaccccaatgttaaccactgttttgttctttgtctctatatatttgatctgtttttcagcttatgattccatatataagtgagataatgcaagttttctttctgtgtctggcttatttcactcagtataatgttctccaagtcacatctatgttgtgacaaatggcaggatctcctccttttttaaggctgaataatattcatatatatatatatatatatatatatcagtttatttatcaaatttttatattgatggacacctaagtttgtcccatatcttggctgttgtgattagtgctgcaatgaacatgggagtgcagatatctttttcttttaatatatactcagaagacagatttctgggtcatatggtagttctatttttaatttatttaggaacccccatactgtttttcataatggcttcaccaatctacattcctaccaacagtttagaagggttcccttttctctgcacccctgccaacacttgttatctcatgtctttttgataatagccatcctaatggtgtgagatgatattgcatagtagttttaatttgcatttccctgatgattagtgatgtggaacaccattttatatgtctattggtcatttttatgtcatctttggagaagtattcaagtcctttgcttattttttatttgtgttatatgtttccttgccattgagttgtacatgttctttatcaatcttggatattgacctcatcttcgatgtgtggtttgaaattttttttctcaatttgtaggttaccttttcattttgttgactgtttcccttgctatgcagaaggtttttagtttgacgtagtcctgtttatttaatttttgcttttgtagactgaatttttggtgtaagattcaagaaatcattgccaagaccaatgtcttggagaggagcttttcctcccctatattttctgctaagtgttttatggtttcaggtcttatatttaggttttttttattgattttcagttgaattttgtgtatggtgtatgatatggatgcaattttattctttggaatgtggaagtccagttttttttcccagtatcatttattgaagagattttccttatcctcttgtgtctttttgatgtccttgtcaaaattagttcaccatatatgtttggatttatatctgggctctctattctgtttccctgttctttgtctgtttttaatgcctgcactattacatttttattactatagctttataatataattttaaatcaggaagtcaaatgcttctaacctttttttttctttagtcagaatcattttgactattttgggtctttggtggttccatatgaattttaggattattttctgtctgtggatatgtcattgagattttaataggaattgcattgaatctatatattgtgttgggtagtgtggacattttaacaatattaattcttccaatccatgagcatggactatctttccattattagtctcctcttcagtgtctttcatcagtgtcgtatagctttcagtgtagatatccttctcatccattattttgcttctaatactaagaagatattcttaatgagtttttttacacttagttattcaatatgactctggaagatttttagaatatttgattatgtcatctagttatttcagaattggaactcaaaataggaaaagagacaatgatttgggttgtaaaatttcagagtattcccaaaataacaattttaaatttgaagcacatgtgacttccccatttggctgttaggtaatgggctcatagcattgcatatggaatgttcttcacttaacatacaaatttcagagcaaaagatgtcatgcccacccatttaataaatgaacaacagcaagaatgtacttttaaatagaatgtgttgtatccaaatgagtgtttttgtgaataccagagttcctagcgtggacgacacttgtagttgctttagaatttcaccacgtctaaagaaccaaggattaattttatcaagagctagtgaaaccaggcttgagatcacacaaaataaaaagatagtttattctaagattgagtgagacctggggagaaaggaaagatcattctgagcaaaacaaaattatcttctcacctagccctcccattgattcaaaccagagtccaagccaagagaaaggcaatacaacagcaaatgcaatatttttttataaagttctcctcaggctgttgagaatgttaaagtcattagcaccgtgggcattaggcttatataaatggtagccttggcagcaactgaaagcatccaagtgagcctggaggacagcataaaacttagattcttacttctttggaagccaagaggactagattatagggacatttcctctgagtgttaggagtacttgtgaagagccccagggagacttggtttcctgaatatgagaccttgtaatatttttcctgtgtaatatatatgaccatatttttactcactgggttgtagagtcaaggaaactcaaaacagtttatctagtgttccagttatgacaaactactttaggaactagcaacttaaaataacaataactatatcttacaattttgtgggtcaggaatttaagttggccatgggtgactaattcttcttccatgtggagttagcagaggttggtatttgatggtgttcagtggggaaatgcacctgtttggcaggtataagatggcttcactcatgtgtggcatcttgaaaggctgagatcagttgagacagtgaaccaaagtgcctacgcaaggcctcgtcagcatggtgggtttgggtagtcgctagtctggtagtctagtgtttcatgaaccaggcagaagctgcaagaatttttgtgaactcatctaggagattacatagcataacttctgccataccatatttagtggggcagccacaagtccactcagattcatgggaaggagaccaaaattctacctcttgataagaagagtgtcaaagaatgtgcagttgtgttgcacaacttcaatatctagtttcctagaaacacatttggggacgagtgtgtgtgtcgcaacaggcaagagagcatttggttctgaagcttataaaatttgcagttttcataaagtctatagggccaccaaacagttaccatgcttctttcaactaagtgtattcgagaatgttgggtcagattattgtgactactctcagttgctttctccagcttgattcatctgaagccttacctgagactttgcatgccctcaaatagaaagcatgcattgttctttatgttttggcaaaagattttatgaagattctccaatatatattttcagtcttgataggagattaatattttatatttgcctcttaggtcttttgcattcaagaggtgaatctcacaaatgcatttatggaagacaacttcaaagtcatggtagcagaaaggcaaagggttgagaaagtacgtgcactgaaggtagcacatgcagcctgtatggagagtctgccttgccgtttatctttctatttgcacataagctttgtatttgtaaatgtaggcagtctttcttttcttcttttcgtctatctgaacaagctactctgagagagcctattcttttcctatggtcatgactaaagttgaattgcttaatcaatgagcaggagttttacgtaagtccagtttttgaagtgctcttcactgacccacgctctgcagccagaatgatgagaagaaagtgagacaaacgtagagatcaggtcgcagtgcattcatcagaaactgcttagcttagctttttcggcttagatttagtgttcagtgatactgcctaactagattcctccatactttcacttcttcaaagtcagccttagcaactacctgactttgcacagacaacttcataaaatagaagcagctagcatttactgagcgttcactgtgggccaagctctgtgctctgctctttgcctgtgttgttgcttcaatttaatcctttcatcaaccctttgaggaatatcctattactatcatatttcacagttaaagatcctgattcacagagaagttaagtgggagggctgggatccaagtcctggcaattctgactcctgaccccttgtactctgaaatactaagtcatgctcatgcacctggcaaacctaagctttccacctaggaagcccatgacactccctcacctgcccttagtctatgacaggggatggtaggcatgccaggcactatacataccccttggggtgagtgattgacaaactatcaaagaaggagtagctcaataatagctagaatcagaaagttttggagtagaatctcagctctctacattcagtaagtatgtattctagttcagtgactttgcttgtttgagccccagcttgatctttcctaaaatagagatccaatatcatccttataggtgtcttatgaagggccaaatgagataaccacttttcagcacacattatcaggaacagccacataatgtgcaaatgaaagtgcagatgcctttgttaaaaagttgctaaaaatttcaagacagcaccagcagagcgttaaatgaaagcatggggcccttctaagcatgcagtctatgtgactgcacagaccgcatgcccatgagggtggccttgtacatcataaccatttaatgaatattctttccacccctgatattcttcccaccagaagaacctgcctactcccatttcccagagtgttggatcctcagaacctcacattaaggagcctggaatctaatgcttggccctggactaactttgaaccctggcctgtgggctggtttctagttttcccttaccttatcagaaagccatgaatatctatccatcttcaacgagatcccacaaaagttttgtgaggtcttagctaagaggatctatgtctcttgagttggataggaattataaaattaacacaaaatttacatcatttacacatgcttaaactatactagcaacatgaataattataatatcgactggctacaattatattaaaatagtgctttatttttcagtgatgagcctttactctatgtcatccatcaaatttacacaatcactggcaccagaaattcatgcttcctgacactgtcttaggtcagacccttacaattttggtccagagctacaataactcatctcaatctgcagaccaacctccagttctgcaccctcaagtcttttctcctcactgtctccaaagctgtcttcctgaagtgtgtcctgcaatccccaagtgtgcatctccacaaaacacatgctactgtcttatgacagagccttcaggggtgcctcgttgcctttcaggataaataaaaactcttcactctggcatataaagccattcatgagctagtcccagcctacaatctctttaaactcatccttccctgtttctgtcctccctgttcccttcatttctcatcattcccatgtcagcacatcccagacttcagcctaattattttatagttttgttttttaaaaaatcttccatattctaacttgccttgtgcctttgtactcggtgttccccctgccaggaatgctactccccacttccaaattccatcctcatattaagctaataaaactattgagattcaattcaagcctatttcatctatgaggctttcaactatgaccttctgtttcacacagtgtttccatgtgtcacagtaggcaccaccttgtgttataactttctctttatgcatctctgtttcattatgcatgtttgagggtgacattggtaccatattaatcttgttatctacagtgcctagaatagttcctgatatatagtaaatgctatttgctgaatgggcgaatgaataaatagtttttcttgctgtttcaattgaagccctatattgcttccatgttagaatagccttgagatgttgtatacgtctccctatattctcacataaactcattttgcttttctatttcaactttatggttacctttcctcccaagaaagacctctgacctcatccttcacttttctttctatttctagacattaattcctttgctggaatattttatttttctctccttagagaacatatttcaattctctgtcttacacagagagagggattggtggtctggagttttctgctgggttgataaattaacatctgtttgtatgggaagtgaccgggttgttctaaggcattttaattcaggcatgtggactggggtctgaaggattgttcattgacatctctgtgctctgcctcagtcctgtctgtcacagccgcctctgggaggttgggccaataaaggcacaaaggaggtaaacaaaaaaggcagctgagagaagtgagtgtgtcccctgagcatgctggcaagaaaaggccaggggaaagcacctgagaagacagccgctagaatgcagctgatgccagcaacttgcacacaactcagaaatccccatgcctgatgatggagacaatgggaccactctgaatgtgaaaagaatacgtattttactctacctagaaactccggcatgtaaatagctctgaaggctgaaagagctctctaagaagtagttcaatgttggcctttagcaactttgcaggatgttcgaaggaattcacattttcagatgcatatttgagaagaaaaatgtagtaaaaattatcttatcatagaaagcatttttaaccatttctagtgggttagaatggaaaaaaatgtgacctttgtgtgtgaaggctcgagtttgagtccttgcacagtcaccaaggtgctgtaggtgatcttagccaagctgattaaccctacaatatctaatcttgcctgtaagagcaagcagaaatatttagctcttaaaagcatttaagagaatcggataaagaaagtaagctatagaaaatatgaagaaacacataaatgcttgttgtattgactctcagagtctacattcatatctaccagaccaaaaggcttctgtcccttatgaactatgtgattttgagcaattaacttcaacttcccgagcctcagttttctcttctgtaatatggcaataacagtaatagcatctgtttcataggcttaagtgaagtgtaaagtgccttgcacagtgtctgacacataatatgtgctcagtaagtgttaactgtcactcttgtaaccaatagtattactattacaaagtttgaattcatcttacaataatttagttcattatctgagcacagagtttagaatacctgttatgtttgggtcagtccttctgttttgcacgtaagaatacaagaaaagggaaaacataaaccttgccctcctgtaccttatggtctattaagagagaatgactaatcaaataatcacacaaacatattaggaagtttgaaggcaagttgcaggctcctatggtagagaataacagggggatctgaccaaatatggagttcaaggaaaacctcatcaaggaaattatatttgagttgacttttgaaggatgagtagaaattgactacatggaggaaagaatgaaagcattctagtcaaagagagccacgtatgcaaagttcctgggagagactatcttatttgagacacggagagaaggccagtttagctggagggcagatagctgtttatcacataggagaaggtaggtaaaccaagttagatcacttgggattttgtcgactattctcaggctattgagagtcaacttagtgcagtcaaagtgttttaagcaggaaagtcacatgatgaaaatttcatttaacaaagaacatttttgctgccatatgagtaatccacataagagatgatggtcattaaggcaggtcctactcagagtgtgatgtgaagaccagcagcatcagcataccctgggatttattgagtgccacccagacctacaaatcaaatctggggatggggcccagcactcagtgttttcacaagcactccaggtgattctgatgctcactaaaggttgagaagccatggcttggtccaggatgtagccagtgaagactgaagagtgaatggatttaaaaccaatttcagaggttagctgctagaattgacaagatttggcaatatctttactttgggaaatgagaaagaaggaagcatcaaggatgactctaaattgtgcatctaaagaaaccacctaatctgactttttatacttcgttgtgtgtatagatatatctgttttgagattagagaagatgaaggactagggtgtggattttggtttacgtgtgtttgtttgtttaagcatgtactaatccacagagcactgttgatgagatctaagaagcatcattataaaaaatgacttcagatgaaaaaaataacttataactcggaccatctcaacccattggcaatataagcaagttatcactggagagctcatatcctctatgataaggagagctatttttctttaagtctttactttcccaaaatttctcaattttgagtcccccaaattatcttttgaaacatcatgttccactatttttaaaaaaataccttttcagaactatactaggagtgaaacagtaaaagaaatcttgttaaaaatgctactaagataatatactattaaaaggagaaacattaaactcagaatgtgttttgagattaaaaaagtcgctgaccacctaagattgttacactctgtataatgtctataatgattttttaaaggtacctattctttttcatgcatataagagacagccagagtggacatttctcacgtttttaactttctagttgctttgatctgactctgtgtagactcagaccacaatctccatttcacttctttagactcatgatttacatatctttcgctttgtaatgcagctgagaaagctcctactcagtgccataattcccaaagcagcttccgctcatggatttcaaagtaaaagccttatcagagatccctctaggccattggtggccaaccctatttttcaagtgaaggagagttaattatatgctcaatatcaaactggaaagaaaatgtctagcctttatttaggaaaacagtgttgtctgattggatgatcttttacaagacaccactatgacatagtctaggctccttctcaaggaaaactgtctatatgatttttacactaacaaatagtgcttcttaaatactttggtagtatatagtcttcttaaatctccaaagaatcaagaattaattcctagtgtacagtaatctttaggcttctacatcaaatgttggctaattatgacctgtatctggcaggatgcctgtttttctaaatgaagttttactatgctcattttttaatgtattgtctattactccaaaagcaaagttgagtagttgagacagagaccatatgctctgtaaagccaaaaatatttagtctctggtcctttgtagaacaagtttgctgacctttgaagatgaataaccaaatctgttagattgcatacccaattggaaccctcacagtttagaaggattctgaattttcatttcttaatgacacatatggtctcaaaatgtatttttttctgttgtaggaaaatgcctgtaatcatatgggaaaatgttttgcacaaatttatttttcacaaaacgatttctgtcttagagcaggtgtctggtgagtaacgcaaggataagcttattggtgctgatacctcacctgagtagtctgagtacagtgatgcctacctggacaccaggttttggcctcaagttctagtgaggtgcccactttattttaggagagaagcagtaagttgaggaagatgtctgttttgcctcacatgtctgccaagttgtgactcagggcaatctggcacagtgttcacaagtcttcgttaagagttgagtttgcacaatggaagaaatgttcagtatgtttgttgtctgcatattcttggaaagtgctaaattgccacctaaaactgtaatcatatatttatacactggagaattgtcatgagatccttaaccatttctttttacttcttttcttatttccaaattctcgtctcaatatttctgctttcttacataggatgtatttttcattcatttcactgcatttgtctaaccttttagacacaaattctaaatctgaaactaatttcttaaaaaggacttggtcaaagttgaatttgttacatgtcctagcttatgttatcaaaaaaataatagcaatatatagaaccataatatttcctttttaatatatcaaaaatagatcattcactcctgtgataatgattcctttggtaatttcttttaacatgtgttgaaatgcactgtgttttggcagaaagctcatgaaactgagagtcatatgatttgaggtctagtcccaactcttaaaacaattagcatttttgacttcagtttactgaaccactctgaactcatgattttcatctttacaataaacagttccatctcatcatctttaagatcttttttaactcgagcaatctgaaatgcctttgtatgtttcaacttaatattatgttagatgttcaaagaaacactgaattctccatttttaaagtggagtatgatatgtgtttccttcatttaacaatgaaatgtttcatacatacacaaaggagaaattattggaacaaatatccactttacaccaccacctaactttaagatatattaaaactaaaccataattgtccatgattgtttttatggttaaataaatgaagcattacatatacaggtaaagcccttactttatataactatttaaaatgcatataatacttcacagctcttaaccctggcctcctcaaagctcttaaccatgagaattagccatataaccagtatgcagatgtggtatgaacaggtgtaaaattatacctgagaatattcagcaagtaaatggcaaagtaaatgactgttacttccagtctcagaagatgaatccagggacttgaccacatgcaacgccatctaaatcctgcatgttcctgttacatcttgacccttcttttctaaagatacagttttgtatttagtgttctttggaagtaacacaaatttgttctgatcatcttaagcaaaaataataattcactgaaaaatatatggcataacttatcaaatcaaataaattaatgagaatctgaaccttgaaaaagacaaaaagcagtagggttctgtaagttctaggtagcaagaataattggaaaggtttttcctggcttcattattgaatgaacgtaattcctttgtttttgaccttggattcatcaaatcaagattaaaattaccagaagagaaagactgattgcttcattttggatggtttgcccattcctccagtgagggtttgcagagcaccagatggttctaccaaggctgcatgcagaaaggaggtttggttcccagtaaaattttgaggtacaatgacaagaagaagggggcatagatgatattctgccaaaaatatgagaggtaaactatactaattatgtcacctcagaatgtgcctgtcctgtctgtgattacaggagagtagttggctgatggccccagctgcggtgctctgaaacgcatcaccggatcagccaaagttttcatgggctgcttctagccaatgattgagtgaggcagggttgctaagacaggtctgttcctaggaaatgaggaactgcttagaactgtgctgcaatctagacacttcctttcatccagtttttcttccttcttctctccttcacttgacatcaaaactgcatcatggtcttctcatagtttgcttctaagaagacctggaataacacacaaatagttcattaatattcaaaagcaacattaagtggcattttcatgaataattctttaagaatgtcatgctacaatcctatagcctcttctcccacactttcctacatttctcctttaccctgctctcctttttcttttttcctatagcatttaagaccttctaataaactatataatttgcttatatattgcatttataatttattgtttttcactccaattagaatatacgtcctttcagggataagacagagatctattctgttttgttcactgatgtatccaaacagttaacaatagtgcctgccattgcaggcactcaataaatatccactgaatgaatgaataactttatgtccaattgcttgcaatgtaatttccaaatgttttcttttggatcctaaactagataatcccagagtcccagatcctcataacaatgttgagttcatacagacgttatgtttattggaaccaacaattattctcattgctctgcaaaggccatagattcctccaactaaagccttgtgcaattagagagggttaacttaatcctcaaattctcatttaaagcaagttatttctcactaaacaattgcaaatttgaagaaatcttaaattgcttttcttaaagaaaagtatcaagagagtgggtttgtttcagtgccttgttctcacaaagaagtgcttagaagtagcaatcatgaaaccaaacctgtcagatcagacatttgtctgctcactaccaattgtccatcacatgtggccttcttttctccagaggatcattgaaaagatagagccataagtcagacattaattggggcttagttctctttgctattttcagtcttagcagatgaatccagggaatgttactctgcatcctacacagagctgccatggtatacagatcaccatttctgaagcttcctaagagagcaagaagcaaaaacataccgggaggcagaagcatgcagcagctttgtgaatgaggtcagaatatggtgcctcatatgttagcagcttaggtaactacacttagatactgtaatcacaaagcttgtataagtacattctctttgtctcaacctgggactggcagcagcaccagtggtgtttttctgatcccagtctcattggatactcaagcaaatttaaaaattaacgccacatataccttaatgaaggatgtttttcagtcttaaactaaaatagctgaatcttgttttaaatagtggttctactcttattcctggtttgagagtgaaattctttttattataaaaaggctttactgcacttttttcatttaaaataggatttttttagagcatgtatataatcgtgtcctatagtatgtgtagaaaggagaattaaattgacttgaaactcaatgtttaaaacattgtccatagaagaggatcattcccagaatattacattaatagtaaggcaaaattagaaaatcaaactcagacttgtgtttaaattccatttcttcacaggactgttgtgtgacctgaagaaaatactacacatctcaatctccataattgtaaaatatagttcagtgcagtaaaatgttgatcaggttgatcagtgggaaatttaaatataatacatgcaagacgtgttgtacaatgttagcacataatacactcttaatagaatacagcaatcactaggtccttgctgtgtgtgttgttttcagggcctctttatctccagttctcattggactgtactcagttgttccatttcctactataaaactatcgctgctgaatttgtgtttaactgtacatggaaactcctttcaactgtaggtaagaattatctgtgtttaccatgggaaccaatttggttttcttaaagcaagtattagttctactggtcaataaccccagttaatttgttgagcaaggatgttggatgtattgactaaatcatgtcttggggatatttttgcacctgaagtttccaggctcctcttgttcctaattattagagatttctgagaggtggctatacatacacctgggaaatgaataaagtacttttatttaaggagaaaggtaacttggatcaaaatgaaaagaggattaaaaacttgacacgtttcaatcagttaatcataacttgatttcccttcccttccctcccctccccacccctcccctcccctccccacccctcccctccccacccctcccctccccttcccttccctctctctctctctcagtcagatattctgacttaacatagcacttttctcaaaagtttgaaatggaagtatccattagaacatattttaaattatcaagaatatataaaaaattattccccagaaatatgatctcatcattcttattgctccagtcttgaactctttacatctctacctcaaatcactggagttgacagaatcctactatatatttcttcatgcttattctagaaaacctgaaaataaagatgctgaaaagaaaaggaaattaaaccataatttacaatccaccattgtggattttatgtttattctgccagtgttttttcaactcaatatagtatgcgtattctacccatctgtttttaacgcaaaaagaagtttaaaacacagtgtgttttatttttcattaaacattgaaatgaagggtatccttagccaccacccagttcagggagctctccagctgtgtcagttcatctcctgtctaccccccacgctgccctccactgttacacagggagtcaggaaaccagtgccatttactttggctcactagtatcctggggcatttggaggaggggtattgacccgacgtaaattcagtgaggactgagcaaagacttgcagcctatatgagctgcattgtagatagatggtccctggaagaaatgttcactgcagataaggtgaagcttttacctcatgttttctaaagaaccattactttcatctcttagtatagtacaaacatcaggaagggctggtgacgatgctgtagagacttatttgccaagcagctttgggtattccagggaacattcccctcctttttaacatgacacctttttttagttcacctctttgcacgtccatcacattcccgtattttctagtcccttgaaagacactttccatattgattagagtctggaatgttgtgctgatttgagcaaacagtgaaaagccgtcaggtgtttttaatcgggatcctgtattgtcaaaggttgttggcagtagcatgggaggaagactagaggcaggaagaatactttggaaaagtgggcaagagatgactgaaaccgaacaaaacagtagcaaatataataaagtggaggggtaacttggagctttctggtagattcagttaggactgaattactgccccactctttctgctgaagaaatgagtgtcccttcacccagccacaattcatagcagccttgtttactcacctgcagctctttccccactcccaccccaatatgtatatgtgtgtgtgtgtgtgtgtgtgtgtgtgtgtgtgtgtatacatgtatgtattttctctggactaatttctaaaaactggcaagcctgttattttatcattaagtagcactgagacaatggttgtagagaacaagactcatcagacttaatgtgaactaggaggaacacctggaaatgtttaggtcacataaccctgatgctcttaacccttgggatattatgttattgttgctataatttcaaaaagtaaagatgttatgtatttatcattaaaaatttattcaaaatcctgcttgatattagaaacaagagaacatcaaatgtgtccatatctcactttgacctattgtgttatattgagcaatgcactatttcccatcatgacagcacagtcattaaagagagtgggaccactcacaactcagttttccttatacctgcacctccttgtattaagttattaaaccatgaacccatactagaaacattattattagttagctattatgagtttttatctattgacaaatatattttagtgctgtctggaaagcatatgagttctctaataattataaatattagcaaaaattagtacagctactatgaagaaaagtatggaatggtcttcaaaaacccacagataaaacttccatataatccagcaattccattaccatgtatatatcccaaagaaaggaaatcaatatattaaagagatatctgcattcctgtatttattgcagcactattcacaatatccaagttatggaatcaacctaagtgcccatcaaggtatggataaagtgtgatatatatacataatggaatattatttggccataaaaaatgaagttctgtcatttgcagaagaaacattgatagaactggaggcccttatgttgagtgacagaagtcaagcacagaaagacaaatattgcatgttctcattcatatttgagagctaaaaaagtggctcttatgaagatagagggtagactgttggttaccctagactaggaaggggaggcagggggatgaagggaaaaatatctataaagatatttattaccactgaactgtatatttaaaaatggtaaagatgggctgtgcatggtggcttatgcctgtaattcaagtgctttgagaggccaaggtggcaggatcccttgaacaccggagtttgagaccagcgtgggaaacatagggagatccccatctctacagaaaaatttaaaactagccaggcgtggtggtgcacgtctgtagtcctagctacttgggaggctgaggtggcaggattgtttgactctaaagtaggctgtgatcatgccactgcactcctacctgtgtgatagagtaagactttctcttaaaaaacaaaaaggcacaggtggtaaactatgtatgtatgttttacctcaataaaaagaaatacacaaaaatattagcaagtcaaattatcctgcatccttgtttcccaatcaagaaaaagaaagtaccaaaatggagacaagggacattccaccagatttaagcttttgtgtaactattcaattccaaaaatagatttttccatataaggtaaaaaccttgttttctctccacaattgtatttatccatagaaattaaaggtgtcattaacctaaatcctgtcagagcctcatctgtgttgacactctccaacccacatggtaattactgctgctatataaagaaggagttaaaattctcatgaaatgtctgccctctgactctgctcttatcattcacatctctgaatttgaggctgtgggacttgcagcctcccaccttaaccctaagagagatttgttgcactgggcctgaattgctcttgactgaaagagttgatcattgtgcccacaggtaagagaggaagagccagatcctggagaatagtcttgaattattgcattcataagaggtgaaaggtgtcattagaaatgcagggtggagggcttgctggaaagatttaggaaagcagagaagcaaaggataagcgagcatgctaagtataaagagtcttgcattgaacatgattggtagcttttggcatctattatctttctagaagataatgcagttggtatatgctttgtgttcttctaaaattgagaaagaaaagcataaatatacctgaatattcgtaagattattggtgtggataaatctggagggacagttgaaaggaaaaaaggaaggagggagggaaggagggagggaaggagggagagatggagggagaaaggcaggcaggaaggaaggaaagggaagggaaggaaggaaggagggaaatgaggaagggagggagggagggaaggaacaaaggaaggagggaaataagggaggaagggagggagggagggaggaggaagggagggagggaaggaaggaaatagtttttatgccctttacactgtttctctcataaacttttttgtcatataggcactaggaaggtagacatcagcctagttcatgtaaaatcattccaaagcttgaatttagaaagatccaaagtaatgaagttttattgaatttataaaatgttagtgatcacatcactgtaacttaaaagacaaatctcaaagtaaactttcagttattccagaatataatgtgaaatgatggctgtgcctcaagggctgatcagtgaatattgccatatcaacagctgtttccttggttttcacctcatgtggttttggctctttccaaaatatattggtgcacctatgcaaaggctctttggagacagtaatgatacttgtctgagtacacagatagaagattttcaggaaaattaatagcctcggttatgatttggtgatgttcttgcaaggtaattgacagagaggtgctttaaaatgtcaaccaaaatgtcagatttcataccgttctttgtgtccccactattactttctctaaggtctgattattagtttagcctgatggctctttttgtttctatcatagctacagcattgaaaaaggctcccagtctgaaatggtgaccatagataaaatttcaattaagaaccattctgggatgacgaggatagcagtgtttggctatgggtatggctcatttatgaggcttctccatgaatcacaaacacttgagttgatttattgtctcagcatttttggggtcactgtattcactactggagtgaaggatgtgacaatgttacaatgaagggaaccaagttccagatgggttaatcgacttccctatcgtttcatggctagttagtattagaaccatggttagatcccaggtcttctagagcctggtaatgagctattgaaatgagattgccatggcatagatattggggcagatgaatgaaatgggatgccatagggctaaaaaaaaaaaaaaaataaggaggaaatcatgactctaaaactattgggagaatacagaggaacgagcatattttatattccatgtgtaacttatgagagcagcacatcatacatcatccaaccattcttttaaacaaatacagcagcagctacgataaaataagacttttatatcagatggctcctaaatataaattagtggcttcacctggtgtttaactgcagaaaaaaatgatagatcccaaggctggatgaatacatagctgtgttggaaattatgaggtctaatacagtgtatgcaagacaactcaaaatatcagggatatttctgaccctcatatttttgtcttataccctgactttgaaatcaacacccaaataagacaagaattcacagtattgaagtctttttcccctcatcaaaagaaaatgaaggaaaattatgtatgaatagattaatagtttagtttttaagcaacaacaactttatcatcattttcaaatattcctgtccagaatgcctttcagtaggaaatacagtgcaagatttttttacatatttctaaaatacatattttaaaatatatttaaacattgaaaatataagctttaggcagtaccatttggctactatattttgaatttgaatcttaatgacatttctcatggttttttgctcaaaaattgaatggaatttgattatttcttcttcaaatattttttgaaatgtgacatgcttactgaaaaatacatgtaagcatttaagaactgaacactcctatgtaaacagcataaagatcatgtaacaaaacttgaccagcatcctacaactcccagacctgaatgcctttctaatcacaatttccccaaagtaaccgttaacctgacttttaacatcatagattagttctgcctgtttttgtatttaatgtaaacaaattcttattgcattctatttgtgtttacgtattttacttacattatattagtgatattcatctatttggtttcaaatgattgtaagtcactcattcacgctgatgtataatgttgtattgtgaaactaaattttaatactacctgtgtttaaagtagatgtattaatttgaatcagccagcaatgtatgagagtttaagtggctgtgcacgctccccaaaacttgatacttttcaccttttttattttagcattctgttgggcaagctttgatttttaaattgactaaataaacctctggcaaactcataccaaacaaaggtctttattgaagaacgagtgtgtgctgggggtgggaaggggcaatctctcataaagtggaatgcttcagcatcaacgagttcaaagaggaaatgcagtttgaataatgtaagcagaaatgtctcagcacagacaagtgtttttgtttaaaatacttctttattttcagaaaaagcatttcctttggaatgaagagagatgtatataggatagaaatttatggaacctgaaaactgacatttttaagatggagggagttgtgggattgaagaaaacactaagggctttattttttattgatgattgagatttccatagagataacacaaggcaatggttgatttgtatttttttttctttactgttgcagggtctccattttggtgcctactggatattgttcccataaagaatgaaaaaggagatgtagtactttttctggcctcgttcaaagatataacagatacaaaagtgaagattactccagaagataaaaaagaaggtttgtaccgttttcagaaaacattgacagatggagtaacattttgaaattgtttacttaaaaactcttggagaaaaacatgcatttttaataacagcaactgataaatattcgtaactgttagcagtcagcatttggtgcatattccaaatcacagactcacatgcatttacattctatcgtctttataataaagacacacttgacaggaactagaagttcatattcctatgctaatatgaggaggatgagaaaacagtttatcacaatgtaaggattaacaccacttcattgtattaggcaaaaattaatggatgggataagtgtctttaggaggatgtgatttaaaatacatctctccatttcctctagattgctgtagctcaaaacttagatgtgcgaagtgtagttatgtacaaagttaagaactctagcttagtggttgttagaatagaatgttgcaaacaaatgtgaatcctgtaccttattgtatataagaatataatacttggttttaagacataaacaagcttttcagttatctttaaaggagtctgagaatttgtgttgtttaccttgtatcttctggttataatttattaagaaattctttgcattttgtataagctgacaaaagttaacactgaaaaactgctgatattatttgttttaaaccaaagtaggattctagtcaccagagaaaaagcaattatcctttgtggatttctatgtagtaagttcttttttagaatcagctacttgacatttcaacagctatgtctttttaggaatggactcttttattccagctcttttttaaaatgtgtgtgattgttttcaatacattatgtttcttgaaatgacaacccaaatgaacagatatgatagtttggtgctctcacttctagcatttgaaagccttgcaaatgcatgtctgttttgctgtatattggcatgactaaattatgtagtgtattttacatatgcaagggaagagccatattaaaattaaagttgcttgaattttagagcaagcatagtacctgtccaatgtaagttccacaaagataagtatgaaaattggtgtgtatagtttttgcttttaatattttctttgtaagatagaaacacaaaaggtaaggatcctttgaataaaattattcaaacatgtaagtatatattcatattatgtacattcacaaatatgtgtggataaatagaaatataacacaatccttagaaagaaatacatgacttttttttgcttgaaagaaggcagtttgattaacctttaactgacttgtttggaatatgaggaccatgcctaatggttttatacaaattccttaattatctttgtctcatgttccttatgtctcgtgttaggggagaaatccccatcttggtggactgcagtgaataacagcggtgaagtataccttttcatttagagtttgagagagctcaataaaaatactcatttttgccatccacgttctgaatcagctgaaaaagaaaaatgagtagattggagaccaaaatatcacctttatttttgatgaaactaataaaggaaaacatgaaatatgtctacctccaagtgggcttccttctagtgagctctagttttaggcaaagttgcccctcagtcacaaagcagagcctctcactgtgtaacttaatgtctggagaaccagagcagaacagttgctccctaaagagagagaagacaaaggggtcatcctatacatgtccatatcaccttccaaacttaatcaaattatattcttcttcttttcccggaaatagctaagttaaggagcagagagaggctagcatgtcgcactagtagagctgctggcacttgaaagattacacctgtcatttggaagtgaaggacatcaatttgaacactgtgcaaccaataacaaagtaatccaaaattctatcttaaaatggtgttaacatttgtattccaatacatgtattaaattgtgctcaataatattttcattttgcttagggaacatgtacaatgtaaagactatctcttgcaagatttaaataaaaaatatcaacaaaacacttttaacattaattatattgtgcaaaatatgatttaattttttgaaatatttgctagtaagtccctagatatatttatctcaacattatctcatataaaaatattacttctaatatatactgaacactcaagaacagttttttctattgctaccttattataaatgtcccatagaagtatgtagtatttttagaaagacagagtaactgttgtaagtcactatggttataaaatgataattaaaaatagccaacaatctaggaggccaaggcaggagaactgcttgagcccagagtttgataccaactcgagcaacatagggagactctgtctttaccaaaaaaaatataataataaaataaaaaataaattaaaaattagccaggtcatggtggtgcgcacttgtagtcccagctatttgggaggctgaggtgagaggatcacttcagcccaggaggtgaatgctgcagtgactggtgattcactcctgcactctagcctgggtgacagagtgagaccctgtctcaaaaaaaaaaaagaaataaagaaaaagaaaaaaaaatatttttacctgcccttaatggagaaaaacaccttaaaatttaccaattgatggcatgtcttgcaggaaagacacaccttaacatatgatatttttaaagcttccaaataagtgtttgattattaaaatgtcaccatgtaactgtagcagtattatgtcataacattaaaaaaaactaaatgagtgcatgacatgacccagtgttgcaccttctgcaaatgcatcactaaagttcatctaagttgtaggaataaggttcatgttaattaaattaattaatactgaggttcacatgatgggcttcatttaagagatataaatggcatggacttctattaaaaatactttaatcatttttctatgttttgggggagtttatttaaatgaggaagaacctgttttatagaagtggctaatgaggtgtgggatataatataggccttttatcgatggacagcattggtggaagatgagcacaaaattcaaactactatttgtatgtacaatagctttcagctggtggatctgctggtgtgtgtgtgtgtgtgtgtgtgtgtgtgtgtgtgtgtgtgtgtgagggagagagagagagaaagagagagacagccttcagcaggattctgatggttcttaccacctttaaaactaccttcttttttggcacatagtttacttctattccaaaaatagtgtgtacaccacttacttctatgttcatgtcaagtgttacttatggagtgaatttaatacgaggccctgtttatatctttcggtatcagttaggaaatactttgatataaaatttggatttatatgtcaatcagcttggcaattgaggttcttttgttgctgatcagaaatcttggctggcagttaaatatgtcctttttataaaaaaaaaaaagaaaaggaaagaaagaaaagaaaaggaaagaaagaaaagaaaagaaaaagaaaggaagggaatgtctacttagtacaagaagccagggtaggcaaagtcttttttggacaccaggtcctcgatggtggggaaggattaagaaaaacattcacagggctgagaacggagggcctttggttggagtggttcagagggaattgtttcctttgagtgaaggaaaatagcctcagcagggggctttaatttttttagttaattaaaattaaattaatttaattaaattcattttaaaaattatatttaaaatttaatgtaagtttaaaagtggattaataatatattaagtaattcaaaaaatatttattgagcagccactctgaccccagcattgcattcgcatttggagatgtcaaaatggagacaatatgcttggagacatcttaagtctcagcttaaatcctttccactaaattttggctgttagtccttctagaagctgctactgtctcaggaactgagtttcctcatctataaaatgaggtactcatacatatctcctacatttgttataggtttataagagataatatatgcaattcacgtagcacagggcatatagaatatgctcaataaaagatgtggtcatgtttgttatattctataagtttttataaaaatagctagctcttattgagtctctgcttcatgctaagtgcttcacataggtgacttcatttacttctcataactctgtgaaataagtattattcctattcccatttattgatgaatttaaatgacttgacaaagttgacatagtaaaaaaaaaaaaaaaatggtaacctaggatttacactcatgcagcccaacctcagagcctacattatgttttttctccctcacttgccctcggcaaagtgctcgtaatcttatggtggacacagatccagttttgcgatacagtatgttcagtagaatgacagaaataataaattcttctcagacaaggaagcaagatagagcgggtcagcaagaggtagagcagagtcaaggagaacttcacaggagaaataatattgaagcaaatcgtgaaagatgatttgtgtgtggagtaagactgaaaggaaagaatgttaattttaggtgatgaaacagcaagtagttgacctttgttcataagaaaagtcatgaagttgaagttcaaccctaaggagtttaggtggtatgcagatatatttcagagttagaacagcttggccttgacataagagatgaaggaaaacgagatcttttgggaccctctttctggtttaagggctgttatgaactgattcgtgtcactcccaaatgtatatattgaagccttaacccccagttatctcagaatgtaacggtatttgaggcctttgaataattaagttaaaatgaagttgttagggttgcccctaatccagtctgactcttatgagaagagattagaacaaacaaagagacaccagcggtgtgaatgcacagagggactgctgaccatgggaacagaacagccatatgcaagccaaggagagtcctcaggaaaccaacctgccaaaccaaccttaatcttgaatctctaaccaccagaactgtaagaaaataaatttctgttgtttaagccactcagtctgaggtacagtctcccttggtgtcattggattggttccactacatcctgaggataccataatccactgatgtttaaattcctcatataaaatgatgtaatattttgtatatcctcccatatactttaaaaaaatctctagattacttataatgcccaatgcaatgtaaatgctatgaaaatgatttttgtgttgtattgtttagggaataatgacaagaaaaaagcctatacatgtttagttgaaatgaaaccatccactatttttctgaatatttttgatccacacttggttgaatccgtggatgtggaacccgcagatacagaaggctgactgcattttgttatagcagccctagcaaacataattaatgactttaatccagatggtaaatgcagaagagaaataagtttctgaggaacattaatgaattcagtattgggtctactgtttgaggtttctattcatgtcttataggcaaatagacatgagggtcaggtgatcaagagagagttatggactgaaggcatagatttgacagccatcaatatattgatggtaatgcaaaaaaaaaaaggtcataggtgagattctttaggaatactaaagaaaaacttcaagaggagggaggaaagaagtaggtcaagggtaggaccctggatcatactaacgtttgaggaaccaggaggagagtatcattaaaggagatagattaataatggtgagacattagagaaaaacggaaccagacatcatagagaaattaagtcagatgaggacagagatgtgcccattgggttttttaattgaaagattacaggattgctgctaaaagcagtttcaagagagtgctgggagagaaagccaataatgagaatcttactaactttccaacactttgggccatcacattattaaaattaaggagacacaattgtagcactttcttgtatgctcttagctcaagtaagtagattttaagttcaaattatttaagaatcagcttaataagctccccacagtccactttttgttgttgttgttgttgttgttgttgttgttgagttggagtcttgctctgttgccaggctggagtgcagtggcacaatctcggctcactgcaacctccacctcccgggttcaagtgattctcctgcctcagcctcctgagtagctgggactacagggatgtgccaccacacccagctaatttttgtatttttagtagagacggggtttcatcatgttggccaggatggtctcgatcttgtgacctcgtgatccacctgcctcggcctcctgaagtgttaggattacaggcgtaagccaccatgcccagccccacattcgactttctaactaccatttcaccttctaacttttttgaaactttgggacaagtcaagctgccctgttcattttcagctcacactcttctttctccttacccaggagaattttccctcacttggaatatatctttgtcacctattcatcatgaaaatcccacttcttttctgtatagtcagattttcctgatctactttagttcatagtaagtgtccttcccttaaaacactctattccttgctgctggagtcatctttctaaaccttcttgcaccggtgtatcaaacttcttttttttttttttttttttttttttttttagtattaaagctagtttatttatttttttaattatactttaacttttggggtacatgtgcacaacatgcaggtttgttacatatgtatacatgtgccatgttggtgtgctgcacccattaactcgtcatttaacattaggtatatctcctaatgctatccctccccccgtccccacaccccacaacaggccccagtgtgtgatattccccttcctgtatccatgtgttctcattgttcaattcccacctatgagtgagaacatatggtgtttggttttttgtccttgtgatagttggctgagaatgatggtttccagcttcatccatgtccctacaaaggacatgaactcatcattttttatggctgcaaagtattccatggtgtatatgtgccacattttcttaatccagtctatcattgttggacatttgggttgtttccaagtctttgctattgtgaatagtgccgcaataaacatacgtgtacatgtgtctttatagcagcatgatttataatcctttggttatatacccagtaatgggatggctgggtcgaatggtatttctagttctagatccctgagaattgccacactgacttccacaatggttgaactagtttgcagtcccaccaacagtgtaaaagtgttcctctttctccacaccctctccagcacctgttgtttcctgactttttaatgattgccattctaactggtgtgagatggtatctcattgtggttttgatttgcatttctctgatggccagtgatgatgagcattttttcacgtgtcttttggctgcataaatgtcttcttttgagaagtgtgggttcatatcctttgcccactttttgatggggttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagcccttgcccatgcctatgtcctgaatggtattgcctaggttttcttctagggtttttatggttttaggtctaacatttaagtctttaatctatcttgattaatttttgtgtaaggtgtaaggaagggatccaatttcagctttctccatatggctagccagttttcccagcaccatttattaaatagggaatcctctccccatttcttgtttttgttaggtttgtcaaagatcagatagttgtagatatgcagcattatttctgagggctctgttctgttccattggtctatatctctgttttggtaccagtaccatgctgttttggttaccgtagccttgtagtatagtttgaagtcaggtagcgtcatgcctccagcttttggctggaggattccagccaaatcttttggcttaggattgacttggcaactcgggctcttttttggttccatatgaattttaaagtatttttttccaattctgtgaagaaagtcattggtatcttgatgtggatggcactgaatctataaattaccttgggcagtatggccattttcacgatattgattcttcctacccatgagcatggaatattcttccatttgtttgtatcctcttttatttcattgagcagtggtttgtagttctccttgaagaggtccttcacatcccttgtaagttggattcctaggtattttgttctctttgaagcaattgtgaatgggagttcactcatgatttggctctctgtttgtctgttattggtgtataagaatgcttgtgatttttgtacattgattttgtatcctgagactttgctgaagttgcctatcagcttaaggagattttgggctgagacaatggggttttctagatatacaatcatgtcatctaaaaacagggacaatttgactccctttttcctaattgaataccctttatttccttctcctgcctaattgccctggcctgaacttccaacactatgttgaataggagtggtgagagagggcatccctgtcttgtgccagttttcaaagggaatgcttccagtttttgcccattcagtgtgatattggctgtgggtttgtcatatatagctcttattattttgagataacgtcccatcaatacctaatttattgaaagtttttatcatgaagagttgttgaattttgtcaaaggccttttctgcatctattgagataatcatgtggtttttgtctttggttctgtttatatgctggattacatttattgatttgcgtatgttgaaccagccttgcatcccagggttgaagcccacttgatcatgctggataacgtttttgatgtgctgctggattcggtttgccagtattttattgaggatttttgcatcagtgttaatcagggatattggtctaaaattctcttttttggttgtttctctgcccggctttggtatcaggatgatgctggcctcataaaatgagttagggaggattccctctttttctattgattggaatagtttcagaaagaatggtaccagctcctctttgtacctgtggtagaattcggctatgaatctggtcctggactttttttggttggtaagctattaattattgcctgaatttcagcgcctgttattggtctattcagagattcaacttcttcctggtttagttttgggagagtgtatgtgtcgaggaatttatccatttcttccagattttctagtttatttgcatagaggtgtttatagtattctctgatggtagtttgtatttctgtgggattggtggtgatatcccctttatcattttttattgcgtctatttgattcttctctcttttcttctttattagtcttgctagcagtctatcaattttattgatcttttcaaaaaaccagctcctggattcattgattttttgaagggttttttgtgtctctatttccttcagttctactctgatcttagttatttcttgccttctgctagcttttgaatgtgtttgctcttgcttttctagttcttttaattgtgatgttagggtgtcaattttagatctttcctgctttctcttgtgggcatttagtgctataaatttccctcttcacactgctttgaatgtgtcccaaagactctggtatgttgtgtttttgttttcattggtttcaaagaacatctttatttctgccttcatttcgttatgtacccagtagtcattgaggagcaggttgttcagtttccatgtagttgagcggttttgagtgagtttcttaatcctgagttctagtttgattgcactgtggtctgagagacagtttgttataatttctgttcttttacacttgctgaggagagctttacttccaagtatgtggtcaattttggaataggtgtggtgtggtgctgaaaagaatgtatattctgttgatttggggtggagagttctgtagatgtctattaggtcagcttggtgcagagctgagttcaattcctggatatccttgttaactttctgtctcgttgattctgttatcttgtcattcccaagtcattatgggccttgaaaccggcatagggcttcattctttgcatttcctacattgccttaaacataatagaaactgagtaaatactttcttattaattaattgtattcaattgccctcacctgtgtgatagtggttaatgtcttttaaaagttcctttcctctgcactcagttgcatttgtgtcaattttccaaacatttttcacagcagttcattcattatgttaatttggttttccattcaaaccagttgagtataataatacatgccttgtttttccaggcacagagcccaatgaaattatttttgtttatttcttgttgagtgtcccagatttgctttggaatgttggttgatgctggcttattcattatgtgataacaacatcagttatcatagaatgaggggatttcaattacaatttctaaaaagtgagcacttcaaatttgttttgagaatttaggggttgatgtgtgaagcttttcacattatctttagtggtaatacaaatcaagattccaacgcagtggcatttcttggttgtctaagtggcaagctgcagcaggttggcattgttaattacactggtaaaagttttgtgttgcagataccattgcctattactaagtgacttcagaagaaataaaataataaacagctattctaaacaattatatgtgcattgcctttagctacaagaacctgcaaacctaactaacacaagattaaacagtaaaggcttattttcctcatatttcaaagagcatgggactgcgcagcccgtggttaggaacagtggctctgtaatactggtgggcactcaggctcttttggcccttctgctctgctgtcctttatgtgttggttttcttcatcttgcttgtcacctgatggttgcaagatgcatgctgcacctttagaactcatgtctgtggtgcagacaataaaaagagtgaaggacaaaagccaagggcctctttctatgagggttctcctttgtttgtaggaaggaatgtctttccccttgcctctttctccttccagagatttctgtcaacatgtcatttaccataactttgtcacgtggccatggccatttctagctccaaggaatgccaataaatcaaggtttgggttttttccctaagcttttatatctctaaaatagaaatagccaaaagagaaagagtcttggaatgagattgggtcaggcaatctagagtgtgtgtcaaggtatcatgtattgattattttctatatgccagacatattatcccaggatcctacaatgtagaagaatgagacttagagtgtaaagtgaactgcccaatgcctcggtgctgtgcagagatggagacagggtaaagttcagggccatctggtctcagagcttatatatttccactataccacaaggggacctccaaggaaacaagtgagacgaaactggaaatgatgtggaaagaaaggtgggcttatctccgtttcttccccaaacccctacaagcaattgttattgaaacagagctcctatcacaattatttttaccattctcatttgttatttaaaatccttactattcaaagtgtggtctgagggactgacacttcagcatcacctgggagctcatttgaaatgcagaatctcaggctctagattagacctttcgatcagaatctgcatttcagtgagctcaggtgactcacatgcatatccaagtttgagaagccctgtgacatatacatttcttagaaggcttccccaaccatccagattaagctaattcatcttcagcgattccgttacatcaccctgttcattgttttatagcatgtatgcctatctgaaacaacattactaaaaagttggttttaattgtaattgttttctgttccactaaaatgtatgtttcatcagggaacagactttgcttttgttgaggatcttatctctaacacttgcagatagagtgtctgacacatagtaagtgctcaataaatatttgatagatggatgatgagtatatgaatgcataaatgatgtctaatttaggatgcttggctcttcagagatagataaccacatagcattcttgctgtttcaaagtaaccagatcaaaattataaaagctgcatttctcaggtgcacattctgaaaactgtattgtttggctttgttctgcttgatttaattcaaagacgatttttcatgtatttaccttagtcttagcctctctaaatgtgttcttactgctggtattgaatggccctttggctttgaatagaatctctgttgctggttaattttttgttctttttgactcttctgttgttaagtttacaagaatctcaatttggtcaaaattttgaagataattgaagttatttgttataaaaaataaaaagtcaccaaaaggagagacattaagagactgatcagatgttaattaaatctacggtgattgatatgtacttcgaatattttaattttcaacgtggaacattgtagtaatgttcctttcacttgctgaagtattctgcctgattttcttttgtttgcataatggaaaaaaacacatgcaaaatttctagtaaagagaagttgcctgatgagagaattattataaaaattgatactttatcccaggaaatagatttctgcttcagggacatctataccaactctttgtcagatatgtgatggcactggaactgaagagctcatatagatgcttaaactgatttaaaaattttaagcacatctatattttattttattagctatgtttaaaaaatgatctttggagtttctacacatattcgctaatgtctttttctcccaaaaccttttaaagacaaataatgcaaactagggttcataaactaagttgcctttagagaccacagtatgatgtaatgagaaagatgttgccataggctgtggtaagtactaggcataatagtcatggcatgcttcaccaagtcattccatttgaaagaaaaatttaaaatatctgcagccagtcaaaatactctcgtggattgcattcgttctgatggtgagtagcttgtgatcctcggacaaaactttctgaagctattatctcattagccttattttttatacaatatatttctagttttattactttaagattaaaacatcatttttgcccctttttggaatttaatattaaaaaactttttgcaattaaatgaccaattcattgaaacaccaggcaaatatggtattaagaagattaaggccaggtgcagtggcttccatgtgtaatcccaatttgggtggctgaggcaggaggactgcttgagcctaggattagcctggggaacacagggagacactgtctgtacaaaacattgaaaaaaaatttagcctggtgtggcggttcatacctgtggtcccagttactcagggagctcaggtgggataattgcttgagttcaggaggtggaggctgcagtgagctgatagcatgccactgtgctccagcctgggtgacatagagagaccctgtctcaaataaataaataaataaataaataaataaataaataaataagttcaggctgagagctaaaacagccagagccatataacttgaccgcctgtatggatatacattcttgatgatgttcgctatatccagcaatatttacctagacattggtattaaagaatattcccagtttggggattacagctgttatgatactgtcatggatgataacagtgtcactgaggacaggctggagacctacagaaaggtctataggtaacttttctttgacctgctggcattttctgtggaagcatgctggggaatggcagaaaatactgtgggtttgtacttcagtgggtggtgtggctagtgtggagcttttcccttttttgcctgagtttttatatggggttactgaggtagtgactttgccagtggggaaaaaaacagactatttggtaccaagagcataggtgccaattatttggagaagtgtctgggaaacactaagtaccctgaatgggaaagatagggtccccagttttgggggattttgagtctagtttctgccccatgcttcagtaaaaataagctttgcatcccagctagcttgttttcagacagtaggaaaaaaagtgtccaggagtcactatgtatcaatcctgcttatctccccagtgagcctccccaaaattccatgatgctttacatagatttatatatatttatttgacactttgtgtgggggaacaatttaactcatggacaatatagaagtttcaaaggcaaatgtctactgaaatgttcacatagttgcttcagtcttgtaatattatatagcatttaaattttatttgatctacttcaaaaatacatctttgagttcatgagaaaaatacctacaaacataattaggggactgctccccagtttggaggatgaaaattttgcccaagtattaatttctcaaagcagacactcatattaagaatgcttatgcaatgtgggaggtgagctgaacaaatattaactagaaagctgctaaaatgactgattgcattgatgaaaacttcagaacttacaaatggtgcttatgagcacactggtttgtgctctagttttttcatgcattcctttcctcttctagactatgagctctgtgaaaacagatgccatgtctgattcacttttgatcccagtaatttaggctaaagtgtgaggactctcttgagtggcattaaaagattcagaagtcttatggttattcgtaataaactatgaggatgcaaaagcataagaatgatacgatggactttggggacttgaaggaaagggtgggaagagagtgagggataaaagactacaaattgggttcagtgtataccgctcaggtgatgggtgcaccaaaatctcacaaattgccgctaaagaacttattcatgtaaccaaacaccacctgttcacccaaaacctatgaaattaaatatatatttttttcttaaaaaaaaaagacatgaaaaggaacaacttctactaactacaagtgaagaaaagtagtgagtctattttaaaaattagaaatagaatattccaattatatcagatacaatatatattatttattaattccatcttagtgcaaaggtggaaaaacatacatatccagatggaatatgaaagcaaacacattagagtacagtatgagatagacacttgagagtatcaagctctcaagaaaatggttcagagtaatgcgagcattcagaaatgtactcaagagcatggaaaaaaatactgagatacccagatagaagggaagaatagggcaaagctcttatcacattggaacacatttttgagaagcagccaccggctgagaatcccgatttgattttttaagtacatgttccctctcatggttagagtgctataatatgagcttaaggaagtagttaaattataaagcccaaatggtactacaactatatttcatcttacaataagattcagcaatacctagatgatacattgatgaaaatataagttatttaacagtttgtttacataaattataggataagtacagaaaattaagctatgccactagatgatgacttcctgaatagatagttcagctttttattgaaagagggattgattggctaaattgaagttacagtgacatatattcctattagtgttctgtcattgccttctgtaaaggaatatgacttcaggtaagctcaaacctgagtctactgaaggtatggcacacctggaaaattgattttcaattttctaatgtacctacaaacctctcagaagtatgctggctattggtgagtggaaaagggctagaaggtatctacaacttcacacataaccaaaaacagagaagtggtgaagtggtgaaaggagtttctcaaagcctgtcttcagtcaagtgatttcattggcagcaatgggccagtatgagaacttgaaagctgcagatgcttatcaagctctccagaagtaccgctggctagccattttattccgtgtaacaatttctagatttgtagataggggttttattaatcacctatgttaaataaaagtgtggcgtgtcttttgctggtgttttttggtgtctctccatggtgactatcactcttatgcaattgtacatcaccattggagtcaaaatataaagttttaataggtgagaataataaataatagtgctgagaagaaaaatacagtgaatttgattagctaaacagggacggcaaaaaagagttactaaatgacctaatgtcatgtgattggtaatggctacctagaattttacattgaaaacctttctaaggtaacatcttgtctcataggagaaaggtgttatgatcaattattgaagtctgccaggtcacggtgatggaagaatagagggtaatagtaaaagcagatatttgccatacctgctgttaaggaaagcagtgtcattcttataacaagtagaatgctggagacctcaagcctcctcttgtggggttaactcataaatacaaaatagtatatctttcatatagttttgaagtgaagataatccatccactgtgggttacagttgagttatcaaaaatctgtaattataaagaaatcaattgtgaaagtaaaaatcatgtgatgagctgggggtgcagaaaagacatactgatacagaattcttaaagttgctgcataaaataaaaattttacagtatggctgtgctgatggtaaagtaagagaaacaggctgggcagagtggctcacgcctgtaatcccagcactttgggagtccgaggcgggcggatcacgaggtcaggagatcgagaccatcctggctaacatggtgaaaccccgtctctactaaaaatataaaaaattagccgggcctggtggcgggtgcctgtagtcccagctactcgggaggctgaggcaggggaatggcgtgaacccgggaggcgcagcttgcagtgagccgagatcgcgccactgcactccggcctgggcgacctagcgagactccgtctcaaaaaaaaaaaaaaaaaaaaaagagaaacaattagatttgaggggtaaaaaagttataaataagaggggtgctttggagttgatgaaggaagagacaaagcctatgttttgagcagagtgggaggtccaattgaagacaccagcataaatctgggacaactgaaaggtgacactgacagtgtcccttggtgtagggatgtagggatgtcccaaaagagacttgcttatttaaataaaccctggttctgggtagtgcatgagaaaataaaaagaaaaatttcattaagagtttctagtcgcaatctcacagtcgtttaagtttggaattcataatgcatgtggaatatggagtaatcttagctgaaaattttaaaatgattctggccagacacagtgtctgatgtgctcctcaaaatgtccattctaaatcaggaacagtggctcccgcctgtaatcccagccacccaggagggtgaggtgggaggattgcttgagtctggaagttcgagtacggattgggcaacatagtgagacccccatctccgaaaaaaagaaaacaacagcaacaaaaagtgtctcgtcttgtttttcatttagcaaggaaatataattttcatttccaaattagagatgattattcacatttttaaatctctacaacaaacccctatgacacagtttacctatgtaacacacctgcacttgtatccctgaacttaaaaaaaaataaaacaaaaataaaaataaaaaataaaaaagttttaatgtgactatgtatgtcaaagtataatttttctattctaatattttccaaagagtagtagaagtcataaatattgctggtggtgtaccagtagtgattttggatgacacatcaataactttataaagctaaaaacctattttaatatattttaatatgtattagaaaacattattattttaatgttttagtattattttaatattttagtgcatgaatattattaaaatgatctaaataaaataaaggagtgatttggaagtatatataaaagaaaatatgggccaggcatggtagctcacgcctgtaatcccagccctttgggtggccaaggcgggtggatcacctgaggttaggggttcgagaccagcctggccaacatggcgaaaccccatctctactgaaaatacaaaaattagccaggcatggtggcatgtgcctgtatgcttggctactcgggaggctgaggcaggagaatcgcttgaacctgggaggcagaggttgcagtgagccaagattgcaccactgccctccagcctgggtgacatagcaagactctgtctataaaaaaaaaaaagaaagaaagaaaagaaaatatgaacaggtgttatataagtatggcaaaataaggaagctagtatttgaatgaccagtttgggaagcatttgtcaattataggaagactcaccatggggcaagttgataaataccgaaacaagacagagaaacatagttaacttcaaaagcattagagctctgtctagctgttgatctgtttacctataactcagtggggcatatataagctcctgctttggagtatttttatcatataactgtgcttgatctctgtagtttagaaaacaaaaaatatgcttaaggaaacctagacccctaggtgctcaatatttagaaatttaattttcaaggtatttaagagcggagattacataacggtttacagtttctaataaataagttatatatcccaatgactcctttatgagagtcctggggaaacatttaggtcaggatatgacttttggttgatggtttttaaatttataggcatttagatgttatatccaaccacattttcttcttttcaattgagagctagagattttatatttattaagtaatattaatttttaaaatattaaatttttaactccttttagttttatttcattattttctaccttttgcctaaatcttttttcttatttttttaaagcctttctagtatattttttaagctacctgaaatgctttagggataaaaaataatatctaacatgtattgagtgcttacaagatattcttctaagtattttcatatatttattaatataatcctctcaataaccctgtggtatgagcaatattattatcagtgttttccagggttcagtaacattcccaaggtcacaaagctaaaaagtggcaaagctaggacttgaacccaagccctattaagcttgagtctcgactcctacaacctctaccctataaggtctctgtatcacagtgtaaaataatatatatgtaatatcaggttgcaattaaaaataaaaatagtgacaatttgtatccatttttaaaatgttacatggtcatctatgtaaaattagggaaatataaagaaaatacaaatatatataatatatatttataaaataaatatgtaacatttatttacatgaatataaatatatataattttatgcttacataaatataaaattagaaatataaagaaaaattgaagaactaaggaaatccatcattaataggcttatttaagaaaaaccatctttcacataattttttctttccaaaaaagaaaatattgtgtctctactcatagaacacttctaacaccaaatgtgtgttttttcgacatcaagcaattctccaattctctgtggacaccaagtgggtgtcctgtaatttaattcaattctgacactaactatctgaagttagtgaagaccccacaggttaagggcttactcccataaaattgtgcccatttcagatgccacccacaagtagcaagtctcaggttacacacccttctgtccaacttggctagaaatggagttactacaactactccaacaccctctgaaggtttgataatttgctatagctactcggagaactcaggggcacactttatttacatttactagtttattacaaagatattttaaaggatacaaatgaacagacaaattaaaaggtccagaagggtcctgagcacaggagcttctgttactgtgaacaaggtgcaccagactcgtggcacatggatatattcagcaacccagaaggtctccaaactcttgcatttacggttttgatggcggttccgttatgtaactatgattgattaaaacatcagccattggtgattaactcagtctctaatccctcttcttttggggtgtgagactgaaggttccaaccctccaatcaagtgattggttcctctggaagccagattccatttttcaggagtcacctcattagcataaatataaatatgattgaaagaggcttactgtgaataacaaaagatactcctctcactccatccctttggaaattccagaaatactaggaacctctatgccaggaaccagagaggaagaccaaatatatatttcttattaaaatatcacacatccatttttttctttgtaaattttagtaaattttaaggcaataaacccattctgtaataatcttggcttctaggaaattctttaaagctttatttcttcatgttgaaattaaagaccatttcatcatgcttgacttctttgtgaagaaaacattaaacgtccttctatcaataaggtactttccctcaccaatcatcccattagattttctcagaaaaagcacttaggaaggtgtaaaagaatgagtatttcttcatatccttagaaatgccattagaaagccatctaattcttctcttctgaataaactacaggcttttctgcttcctacttagactctcttcatccccaaccctttatcatatttgttattttccttaagccctcttgaagttcattctatttctcttgagtctagaacagtacatgctaatgcatattatgtctcgtcactactgagtttaattaaagaatagcttttaagtgtctccattttatatattctacccatcagaatgactcttaaaaataattatgactgtcattcaagtcacaagccactattatccttgggatactgtccactttatggtttatagtcagtcttttatatcatcttatgattgcaaaacctgtaataactccatccataccgaacctcaatctgttagcttctgaccacttacttcctcaaggatatatcaaatttcaagatatacaaccccctttctactcacttttctttcttggattagtgcaatcagaaagcttgaatgatgaatatttctatttactatacaatatggcctgcaaataaaaatgtcagaagttttaatgcagagtgaagtttatctgtggaaactggcagattaaatgcgtggatttccaaaacatcactgaaacaaccatgaggaaatttttaaaaagacataaacccacaggttaaaaataatagaaaagacagtaagaacaaaattttagaagctgaaaagcaaacagatgagtgtgaattgacttaatagatctgagaaacctaaatcctaagcggcagtggaaagagctaacaagcaacacgattttcactataggtccctccaaaagttcaaaaattggtacctttggaagtgattatgacagtaagactaaaaccagaaagataagttgaaagcatgtttacggagtgtctatatttatagatttacccccctgatatgtgcattgagacaatccttccaaagctatcacgttccctggaaagcaaaattagtgggatcagtatctgtgtgggaaaggaggaaagcagtgctaagcagaagtcattgggttctgatatagtcacaaaaaaagcctccctgccaggatgacctttcagaatgctcttgagatgagtgaaggacctggaaatttgtaaacactcacactgaacaatcattgtaggcaagctgaccttacaaatggtgcatgatcatgggcaaggtgatcctcttcaaccaagggtgctcccaagagctggggaaatagacccttgattttgagggtggatacagggggaccacagactatccaatgcatcacttttttgcagaaaggttgagtcctattcttttgtgaaggtaaaatagaaagtctctggactgaagaaaatcaggcagtactaaaagaggagaaaataagcaaaagtttatatcccaaatgttaagacacccagtcctcttcctcaacttggctcctataattctagcagccaagaagtctataccctttcaataaggctttggaagaagattttcaaaataacctggacagcccatgagaaaaattctcaatatactgacatcagaccttgtccatccacatcactctatagcaaagaacaaatacgacgcattccacacatgtgctcagactttctattcagatttatctagcttcagtcttaaatatgagcagatgtgaaaaactgccaagacttctacagggagcttcttatggaaaaggtataaaatcaaaataaacaaagagaaaaaatcacattaaataaaaagaaactaacaaaaaaataacaaagctaaatatttaatatctctaaatagataagaataaatacgatattcatgaaataaatataggatataatgaagtaaagaagcacacgaactataaaatttttaaaaaacttgtgaagattaaaagataatgatagaattttttaacagttgagagattagaaaattaagttgaggaatcttccagaaattagagcaaagtgacaaatatgtgaaaaataaaaagaagtaattagaaaattagaggactatcaaggactatattaccctagaattttcagtgatgacggagatgttctgtgtttgtgctgtccagtacagtaaccactagctgcatgtggctattgagcacttgagacgtggctagtgttactaagaaagttagttttaaaaatttattttatatctatcaatttaaaggcaaatgtgaaaagccacatgttgctagccgccactgtattggaaagcatagatctagggggctaagcaactaaattaaaaagagtaccaaaaattaaaaaaaatagaatgaaactgattggaaaggagtagtccattatgccagctaagttcccagatctaaaaacatgagtttccagacttaagcatcatgacactgttaactgcaaacaaaaagataattcgacttccagaaaaaaggaaaaaaaaaaagtgctatacgaaggatcaagaaccagaatgacattggacttctcaagaggagtactgggagctagaagacagtagagcaatgtcttaaaaattctaaatgagtatggcttccaacccagaatctatatccagcataattgccaataaagtcaaaggtagaaaaaatagattttcagacatgaaacgtctctaaaatgtatttccctttcatgtaccttgtattaggtatctactagaagatgtggtgcatcaaaaggaggcaataagctaagaaaatgtaaacatgagattaaggaagtgaagacagaattcaagacagtactatatggtactgctggaatgatgaccaagggtcagctcagggtgagagctacgaactaggttcatcagccatcctgcccagagcaggcagaggctctgggagttttcaagattagttaatattccacttgatgtatcaaaacctattgagagaaaattcacacacaattggagaagactttggatttttattagtaataatgaaaaacatattagagtagtgttagtagcaataaacatatagaaaacaaagcaaactaaaaaaatccagagaattgttaactccaaagaaaacaaaaacttgtatagaaaacaaatatttatcagacaccaatggctcagttgtcacaatattgtaaacactgaatattgatttaagcaaagtaacaatcttaccttgctgcaaaacgaagagatggaaagagggtatgtgtggttaggggatgggatataagtgagccaaagtctcatttgttatatgggaaacgaattggtaatgccttgaaaatcaaaaaataaaaaataaaaaaatggcaacataggtatgttagttgtaagaaagtgattactaaaattaaatggacaaaactcttgaaaagttttgtttctggtgtgaaagaaatgggaggagaggatctggaaacttctggttttctatgaactattggacaagttatgccgcatgcatgtataacttttatttatcaaagaaaaatgttcaggtcaaatgaatagcaccagtcacattcagaattcaccgattaggatggctattatcaaacttgtcctaatgtattagtgagtgataatacatttcctaaaatcttacaaaaaacctaaactaaactaaatacaaataatatgtctcctttctatcaggtacttaaattgatgaggtagcccttcatcatattaggaaaaaacaacctattactcaaaagggaaaataacatttaaagtagacttcatataaagaaaacaaatgagagaagagggtcaatggtcttggtaggaccaggagttctctgcagagaaagagtcgatgttcaattcttactgcatgccaggcaatatgctggttagtctcatcagtgatctctccctaaagcctgacctaaggtcatacagctagcaagtacctaagtttccatctgaagctgactcaaaagagaaaggaaacaattctttctaaagaatgattaaaatcagggctggcacagaggcaaattggtggagagaacatgggagcaggagccccagagccagaattattgttccatcttccttgccaataaaatgaagcaatatgcaaaatgtgaatatgtggctcatttgattcctttcacctatcaggaaatgtgatatcatatcaaggattaaatagtatagatttatatcctttaattatcaacaaaagatccattttctaagtcttttctggatacacacagacacataaaccccaaatagccaaagcaatcctgagcaaaaaaagaagaaacctggcagtattacactagcagacctcaaagtatactaaaaagctatagtaaccacaacagcatggtactggcatagaaagagacacatagaccaaaagaacagaatagagaatccagaaacgaatccacatatctacagccaactgatttttgacaaaagtgcctagaatactcactgaggagttccttcaataaaggatgctactcatataacaggggattaatgtatagaatatgctggaaactcaaacatctcaacagcaaaacaaaagaaaaaaaaagcaatccaatttataaatgggcaaatgatttcaacagacatttttcaaaagaaaacaaaccaatggccaaaaatatatatatgaaaaatgctcagcatcactaatcatcagggaaatgcaaatcaaaaccacaatgagatatcattttaccccagttaggatggctattatcaaaaaaagcaaagctgtggagaaaagggaactcttatacactgttgaggggaatgtaaactagtacagccactacaaaggacagtacggaagttcttcaaaaatctgcaaaaagaactaccttataatccagcaatcccactcctgggaatttatccaaagataaggaaatcattatatcaaagagacatctgcacccctgtgtttattgccgtagtattcatatggattcagtaggcaacctatggaatcaacttaggtgtctaaaaacagatgcatgaatgaagaaaacgtggtacatatacataatggaatactattcagccattacaaagaaagaaatcccgtcattcatggcaacgtggttggaactgaaagacattatgttaagtgaaataagccagaaatataaacagtatgtgttctcactcatatatggaagctaaaaaaagttgatctgacaaaagtaaaaagtagaacagaatatactagatgttggtaagggtaggtgaaagggaggaacaggaagagatttgctaaagaatacaaaattttaactggataggaggaataagttctagtgttctgtaccactgtagggtgactatagttaacaatagtatattttgtagttttaaatagctagaaagacgacattgaatgttcctaacacagaaaaatgataaatgtgtaagatgatgattatgctactctgatctgattgctatatgttatatgtattgaaacagcactaggtactctatgaatatgtacaattattgtcaatttcaataaactaaattttaaagaattgctacttatatattagaaggtctagctgctaaagtttataaattttctatgacataaaacagggaacagggaatttttccctcattaaaaaaaaaaaaggtgatgattagaattcatatggcctactatcagtagacctcaaactaatctgtgcatagtacctttaaattgacagcttctacctaacctaagccctgagtagttatatttcctgactgaagcctaatcagttaccttgggaagaaggatatttcaaggtttgtccattcaaaaaaataaaacttttgatgattccccacaatcttccatataatatttgagtgaaatccagaatgtcacactaaattcaattccaccccagcagaagtgttcaaatactaaaagttaccaaatttttttttaaattccaacaagcccacacatgaaaagaccctgtgaatgttggggtctctctctctctctctctctctctctctctctctctctctctctctctctctctctctctctctctccccctctctccctctctccctctctccctctctccctctctccctctctccctccctctctctctctccctctctctctctccctttctccctctctctctctctctcccctcctccttctccctctttctcagagcaaattttattttcattaccatgaaaactgtggattaaatttaatctgtttttaagggagcagcaggccacactgtcttaatgtaaattccagtgatgctaacacacaccaattagtaaggagaacaacagcttcaggcctggaaataacaccaaatcacaactctgtagtgctcaagtggaatcagaatgtgacaataagattaaaactttataccagccaagtgcttattttctggtatttttctttttgtagatttagcatgcttggttgacttttgattattattaacttaagtggttttccttttcaatccactggtgtcctgttttctttaccagagaccccaacagcaagtgctgccattgtctaagagagactggggtttccctgtagctaaaagaagagagggatgttccctcaaaatgctagttaacttccattttatgcaagttaccaagggatggagaagaactgcctgaatatcaaacttgactctggaaaaattatttggaggttttatggtgtttcataaagtcagaaagcacatcttcataggcatactatttaaaaggttaaaatttagctgaagtgttatgcatagattcattgttgcactcattcattcagcagtcaccaaacatctagacacagaaaggtgaaaaaggaaaattgttacctttacataaaccactgtcaattggagagtgatagtgtctgataactaacatatattattctatatagtaagatagagctgcgaaaaaagtgtttcaagaaagtgatgattatttctgagtggtaatggaggaggatgagggaaatgaaggaaagaattttcaaaggaattgatagtttcagaaggaaaacatttagatagatacagccacagcaaaacatgaaccaaaaatcccattcttgcaaccatcagccatgtcctttttgaaaccacttaacgtaatagttgaatcagaaactatgtgaaaatctgtcatccaaatagagatgcaacaggacaatttgctttggcacagggctcaattcattggtgggtcaagtgtctcacctctcccatcatctctgtgtttcttgggccttgcttgttgctagataatcaggtttttggatcttgtacatgcaggaagctcctgggaggaaaagaaataggaactctgcatcccaaaaatattaaaacatttatgaggcagggctatgcctttgcattcttgctcctagcattgtacctgaatatagtagttacgtctatttaaaaggggagaagaaaacaaaacatgtttttgaatgtgtgaatatgtgaacaatcagcatactgattaccatggtatttgagatggaagaattttccttttattttttatccaagtaaaatttcagtgttgccttacataagtgactaatagaaaactttttcattgtattcattagatctttttgaagatttttttactacttgttaaagaataatgccttatttaatatatagcaacttacaaaaatatttacccaatgtggtgcagaattcttaccctttagcaaatgttgctgaatcctatccagggacagatataacatatcatgaaatgtcaatatataggatgtgattttctttttgtgttatttatggattttcataacttgagaatcataacattattgtttttatgaagtctctgaggaaagactgtgagaaagaagttagcagatctggaggaggtgagagctatcagtaaggtaagaggcttttaaaatgagaataataatccttagattaacattcttgttggcaagatagctattcttgagttcaaaggggtgagtgttacaatctatttcttaacagagtaattttatgaatatatcgtaaaatcgtataatggtgcctacaaagctatttttagtgaatgaattaaataaaacaggagattataactattcataataaaagatgataaacataaggtgaaaaaatacaatttctaataatacttcaggatcacagcctgggagaattatccatgcacagtatttttgaaaaaaggatagcacttgtaaccctgttacatttttcctcttcactccatcagattgattgctctactgtgacttttgctctttcatactgctacacttcagcatagagtgttcctagcaaccagaaggtcacctcctttcccgtctgcttatcacagttacccattcttcaccatttagtgcaggtccacagattgccctacccaaactccctttataagttctttctctgattttttacagtccttatatttgcctctcatgtctaataataataataataatgacaactaacattgattgagtagttaccatgagtcaggcactattctaagtactttatggtttttaccacatttaattgtcacaaaataccttgaaataggtattcttattaacaccatttttaaagatgaataaactgaaaccaaaagaggttaagtaatttgccctagtggctagcaagtgttggagtgacaacttgaacctgtacagcccggttgcagagctattaactactatagccatttactctgcagctttgccttttatttgacttttttgcaatatatattaaataataattaaatatatatttaattatttttactgtgtgtatgtcatagacattttttgcctcttggctgtcttgtattaatttgtcctacacccagaaacatatctgagagggagggatccactatttcctcacgctcagtctgtagttttggtggagggcagtttatccctcacagactccaggagtgttatttgatacagaccaggccaaacagagctgtacactcctctgacatagaaactggttcaaggttagacacacaaccccatcagagccaaagagacattatgagatgcggacatacatactgttgactacatttgaaactgagatgatgcacatccttggagcctttctgagaactgagttaacacagagtcttgaccaaaattcctgttttctctttttcaaacagtttggaattttctagattttctgtcaattgttgtataaagtatcctaattgatataaggctgacagattctctcagattaaatggtaaaattttagacatacggattgcctttctcaaactctttcttccgcagtgttttgcacttatatattatgtaatattgattgaatccattttgaaaatctgtggaattaatatattaacccaaaattcatgccaagtatactgcagcttacatacagactttagtttaactttgttgtgaatttgatttaaacttcattcgaaattataattctaaaaatgcaaatgtgtatgggccaatcaatggcataagaaggaactaagttacttttatctttaccccttctatttttccttattatttctttcttcatttcagaacatgaggaaaacaaggttatgtgatcagtttgctataaaactttccatgctgtgaaatagtatactatagtgaaagggacaccaacttggaaatgggaaacttggcaagccgtataagcttgggtagtcctttaatactctctcagtcttgggcttgagtttcctcgtacatactcggaatatattggattatattacttcttggcatttaaaagaatgggaactctgactacctgaatgtttctgaaccatcagtcacttctcagaaattcttagctcttcagtggccaatcacagcttctcgtcatgtaatattagtaaatattattctaaataaaatctagattaagagagtatgatcttgatctatatggctcttgttagtattatgatggataaaatatttttcctaggtcttatacaaaattaaaatttgcttaaagagcttgctccactgcttttacggatcataactttgaaactgtggaaatcactgggttagatgttctacaagatttcttccagcaccaccatcttgtgaaaagacacaggtcatttcctggaataaatttgagagtaccttgtgtagtcaagatgggcccatttaaaaggatgacttcgtgttgttctggatacctatgatttcagaattggataagttctagtgtccaggattttctgaagatactagttttctccataactgctattggctgctttggctttcacgggatgtcttggcctgtgagttgctctagaattccaaaaatatgagtggttgcattgaatggggaacacaaaggtaattcaggcttccaactgtgggttgtgctaaggagtttggtctttattctttattatgtggtgtgtgagtcctgacaaggcaggcactcaaaagggggcttaggattatttatggttgtctgaggacagcatttctctatttcatcattttatttgggacaagtcagcttgctagctctgcagtatagtaaaaaaaaatcccaggagttacagtttcaagtcctgtctctcccactagttagcactgtgatcttaggccaggcatttttgcctccctaactgcaatttttccagctacagtataaaataattggaatataacatttctaaggcttattttactgtaaggatctaaaattctataatcacactatatgacacaaaagcatgaccacacagaaccatacttacagattgggaactatgaccctgttttccaaatctcccatctgaactcaccagagccagtgaacattcagtgtgtttgtcacatgcagtattaccagccagaaaacactcttgttctagcctaagttcttgaaattgaagtatacattcttttttctgatactccctcagattcatttggaaaaaaaaaaaaaacaactcaataactgtaaatgaagaaacactttctaagaagtgtcatgcataagattatagatgatcatacaaagtaccatgggtccctggttaccttaaggtcctattcaggagaaagataaaagtagatgttagtattcttggtgaattaagtgggaatttgcatttcaatgccagtccttaaatggtttgattttcataaaccctatatattatagagtgtttgatgttacataatggtgaaatgaatagaaatgagaaatatttgaacttcgaatgtacttgcaaacgttctccccccacccctttaaactacctacatataaaaacctagaatcaattatgtgaagtttaatttctgaaagtttcaataaagctgggtcatcatactttctcctccaaaaatttggttctcaaataggaatatatttagaaaaattgtttatttatattttcttttttgtttgttctataatttaagtttagaaaatagcaaactttttatgtaaaagatatgatagtaaatattgtgggctttatggaccatataaagtctattgatactacagtacttggccaggcacaaagaagcccagcactgtaatctcagcactttgggaggccaagtagggatgatagcttgggcccaggagattgaaagcatggacagcatagacagacactgattctacaaaaaattaaacaattagactggcatggtggtgagcacctatagtcttagctcctcaggaggctaaggcagtaggatcacttgagcccagaacgttgatgctacaatgagccatggtcatgacattgcagtctggcctgtgctacagaacaaaaccctgtctctaaacaaacaaacaaacaaacaaacaacaaacaaaaaaccccacagtacttaactcacccgctgcagcaggacagctgccatagacaatctataaacaaatgcatgtggctatgttctgtacaactttatttgctgaaacaggtggcccattggtgagcaaaagctgacagatacttgatctaggcaattaataagtgatttctccttcaatcctctcccaatcccagatcattccatattgaaaatagcattggactgaatagctggatagcttttctaattactggacattgactgcacataatcccattgaaattctcattgatatggagcttatttcagtcatcatatccagttcttaaattgtattagctatgagttaataagactgttgttgtggtattgctttatatctggtgtaatactttaatatcaggtcacaggaacttctgtaccattaaatgaagatcaggttaggattctgatcaattggaccatatttctggtctggaggggaaagaggtaagaaaagagctcctccattctcatcacaaaagtgatcatgttctagaatcataacaaacatggcccaggattgtgcagacttgaaactggggagtgaagtgtcagtgccagaactggtaaagaaaatgaaggttctatttctgatccaagaggtaggatcacagggcatccaagtctatgcaggtggtccaaggataccctacagtcaaaaagacaaagtattaggagcccaagaagctgggggacacaactaaggtaatgagaaaggaaaagttgcctgcactctctgtgatagctctacaaatgctgatcagcttttgccttatccaagaatttatttcaatgaactgagggactttttttgctggctgttgtttcataaaacttaaaggcacctaggtacttcctgctacccaacacatagtagatagaggtagagccataaatattgaccttcagacatcatttgtagatcagatatcctttgtagatctatttagatgaccttaaaaatgtgttaatagtctattagtagttggctactatgttggcccatctggaatgcttaagtattcctcaaaatagttcttttgtgcacttaaaatacatcacctgacctaaatgaactatcaaagttagttcaaccagggcatttttatcttagatattactgagattattatcgattcataatttggatgcaagtggttgaggcactataatttttcttttaaggaaaaaaatcaggagaatattttatagttggccacacgtatataagaattgcttcaaaaaattctctaaagatgttagaaacttagatcactatttggtgacttgacaaacatgactggagaaagatgaatcaattgaaagttaactgtccttaaattgaattatgtctgattgttactccatttattgtgtgtgacctaaagatttaaaagaaattaagtcatgtattaatttcaagtcatttcattattttggaaaaaaataaaattattgattgcataattttttggttgaattttatggaaaggtttttaagttcgtgtaaaattggtattcagtaggttttcttaacattggcactattgacattttgagttggatagttatttgttgtgggggactgtcttgtgcattgtaggatttttagcagcatccctgttctccacccactaaatgccagtaatacccacacacaagtttaaacaaccaaaactatctccagacattgtcagatatccccttagtggtaaaatctcccctggttgagatacactggtatacaacaaccaggccataactctataacatacaagattaaggaatagaagcaggatcttattaataatacaagtctttaaaaattgaattttggtgttgaaatgaatttatttgtgttatttagtatttttgagtggtgcattattactcaagactttctaaggaaacctaacatttagaaataaagcaatcctccaaaaagggctatctctctgctcctccagctcttacatatcatgttgtcaatatcatgctaaggttgtaataggaagattgtattattgattctgctcttcaaccagagattgcatgcagagcagcaatggtggagttacttctgagaatagaaaatgaattggaccttatcttgggaaccctatgaattagctgagttacctccaagtctctcaacacactttttgtctggataaatcagattgcctacttttccttaaggtcaagaaatatgatgtatttatctctgtctttccagctccatttctggcacaggataaatagatgctttgaaattggatgaataggcggaatctattcattgatcttacagacagagtcagcatgttttcatcttctgttcttcttttttcctcctgtagtcctgtattcattcctgactacttcttggtggcttgatttattcatagataatctgttctattctttcacactcaagatatggccaagattttgttgctttaacttctataagcaaaagggggtcccagaaccaaaaagtactaaggagttttaatgtaagacattggagaatactagtgggaaaatactgtattatttcagtacctaccatcactgtaacaaaattgttactgctacaaattattaaggctgacaacgtttttaaattaattttcacactagaattcttataaacttgcttttcatcttaattatttttaatgtgttttataactccaaaacatggaccaattttatatagaacttaattacttttcaaaatcagttaccaatacttttctttcagacctgcatgataaagacaaagagaaaatgctttagaactgggcagaactaggtgttcattgtcatgtgtactcttgtaaacattaatttggacatgctatttaaacctactgaacttcaatgttattatctttaaaatgggccagtgtctacctcagagtataactataagaatagagaaaaataaattaaatatgatccaagaaagcagttgcattaagtaggtagttgtaagtcaatcataatcataataaatgacatatgcaaatcaataaatatgattcatcacataaacagaactaaagacaaaaagcacataattatctcaatagatgcaggaaaggcttaagataaagttcaacatcctttcatgttaaaaactctcaataaactaggtattggaggaacatacctcaaaataataagagccatatatgacaaacccacaatcaatgtcatactaaatgggcaaaagctgaacacattccccttgaaaactggcacaagacaaggatgccctctctcaccaatcctgttcaacacagtattagaagttctgatgacggcaatcaggcaagaaagagaaataaagcgtattcaaataggaatagaggaagtcaaactatctctgtttgcagatgacatgatcctgtatctggaaatttccatcatatcaacccccaagcttcttaagctgataagcaacttcagcaaaatctgaggatacaaaacaaatgtgcaaaagttgctagcattcctgtacaccaacaacagacaagcagagagccaaatcacaagctgtattagtccattttcacattgctataaagaaatacctgagactgggcaattgatttattttattttattttatttatttcaataggttttggagaaacaagtggtgtttggttacataaataagttctttagttgtgatttctgagattttgatgcacctgtcaccagagtagtatacactgtacccaatgtgtaatcttttatccttcacccccacaccctgtccctcaagtccccaaagtctattgtatcattcttatgcctttgcatcctcatagcttagcttccacttatgagtaaaaacatacaattattagttttccattcctgagttacttcactaagaataatggtctccaattccatccaggttgctgcaaatgccattattttgttcctttttatggctgagtagtattacatggtaagtgtgtgtgtgtgtgtgtgtgtacacacacacacacacacacacacatatacggtagatctacttttatttctttaaggagtctccacactgttttccatagtggttgtactagtttacattctcaccaacagtgtaaaggtgttcccttttcacctcatctatgccaacgtctattactttatgatttttttattatggctattcttgcaggagtgaggtggtgtcgcattgtggttttgacttgcatttccctgatacatagtaatgttgagcatttttccatatgcatgttggccatttgtatatcttcttttgagacttttctattcatgcccttagctcactttttgatgggattatttgtttatttatttatttattttgctgatttatttgatttcttggtagattctggatattagtactttgtcagatgtatagattgtgaagattttctcccactgtgtgggttgtctgttaactctgctgtttatttcttttgctctgcagaagctttttagtttcattaagtcccatctatttatctttgtttttgttgcatttgcttttgggttcttggtcatgaagtctttgcctaagccaatgtctagaagagtttttctggtgttatcttctagaatctttatggtttcaggttttacatttaagtatttgcaccatcttgagtcgatttttgtataaggtaacagaagagcatccagtttcattcttctacacgtggcttgccaattatcccagcaccatatgttgaatagggtgtcctttccccactttatgtttttgtttgttttgttgaagatcagttggctgtaagtatttgggtttatttctgggttctcaattcttttccattggtctatatgcctatttttatatgagtaccaagctattttggtgactgtggccttatagtgtagtttaaagttgggtaatgtaatgtctccagatttgttctttttgcttagtcttgctttggctaggcaggctctttacttggttccatatcaatttcaggattgttctttctacttctgtggagaatgatggtggaatttttatggaaattgcattgaatttgcagattgcttttgacagtatggtcattttcacaatattgattctacccattcatgagcatgggatatgtttccgtttgtgttgtctatgatttctttcagcagtgttttgtagtttttcttgtagaggtctttcacctctttggttaagtatattcctaagtattttaattttttgtaactattgtaaaaggggttgagttcttgatttgattctcagcctggtcacaagtttatagcagagatactgatttgtgtacattaattttgtatcctgaaattttactgaattcatttacctgttctgggagttttttggatgaatctttggggttttctatgtatacgttcatgtcatcagtaaacagcaacagcttgacttgctctttactgatttggatgcccttaatttctttctcttgtctgattgctctggctgggacttccagtactatgttgaatataagtggtgaaagtgggcatccctgtcttgattcagttctcagagggagtgctttcaacttttacactttcagtataatattggctgtgggtttctcagaggtgtcttttattaccttaaggtatgacccttctgtgctgattttgctgagggtcttaatcataaagggatgctggattttgttgaaccctttttctgcatctactgagatgatcatatgatttttgtttttaattctgtttatgtggtgtatcatatctatttacctatgtatccttaatgtatacatacctatgaatgtatccctacattactggtatgaaacccacttggtcatggtggattatcgttttgatatgctgttgggtttgggtcactagtattttttttgagaatttttgcatctgtgttgatcagggatatctgtctatagctttctttttttgttatgccctttcctggttttggtgttagggtgatattggccttatagaatgatttagggaggattccctcttcctctgtcttttgggatagtgtcaatacgattggtaccaattcttctttgaatgtctaataggattcagctgtgaatctatctggtcctggaattttttttttgttggtaactttaaaattaccgtttcagtctctctgcttgttactggtgtgttcagagtttctatttcttcctggtttaatctacgagggttgcatatttccaggaatttattcatctcctccaggttttctagtttatgcacgtaaaaaaggtattcatagtagccttgaatgatcttttgaatttctgtgatatctgttgcaatatctcccattttgtttctaattgagcttatttggatcttctctcttctttttggcttaatcttgctgatggtctatgcgttttatttatctttttaaagaaccaggtttttggttcatttattttttgtatttgtttttgttttaattttatttagttctgccctgatctttgttatttcttttcttctgctgggtttgggtttggtatgtttttgtttctctagttctccgaggtgcgaccttagattgtctatttttgctctttcagactttttgatgtgaacatttaatggtatgaacttttctcttagcactgtctttgctgtatcccagaggtattgatacattgtgtcactatttttcagttcaaagaatttttgaatttacatcttgatttcattgtggacctaatgatcattcaagagcaggttatttaatttctatgtatttgcatggttttgagggttcctattggagttgatttccaattttattccactgtggtctgagacagtacttgatataatttctattttcttaaatttattgagacttcttgtgacctatcatatggtctatcttggagaatgttttgtgtgctgatgagtagaatgtatattatgcagttgttgggtagaatgttctgtaaataactgttaagtctatttgttctagagtatagtttaagtccatggtttctttgttgactttctgtcctgatgacctgtctagtgctgtcagtggggtattgaagtcccccactattattgtgttgctgtctatgtcatttcttagatctagtagcaattgttttataaatttgggagctccagcgttaggtgcatatatatttaggattgtgatattttcctattggatcggtccttttatcattatataatgtccttctttgtcttttttaactgctgtttctttaaagtttgtgggtttttttgtctgatataagaatagctactactactcatctttggtgtccattttcatagaatatctttttccacccctttaccctaagtttacatgagtcctgacatatcaggtgagtctcttgaagacagcagatacatagttcatgaattcttacccattctgacattctgtatcttttaattggagcatttaggccattttctttaaatgttagtattgagatgtgaggtactattctattcattgtgctatttgttacgtgaataccttttttttcattctgttattgttttataggtcctgtgagatttatgctttaagaataatctattttggtgtatttcgaggatttgtttcgaaatttaaagctccttttaggagttcttgtagtgctggctttgcagtggtgaattctttcagcatcttttgtctgtgtctggaaaagactttatctttccttcatttatgaagcttagtttcactgcatacaaaattcttagctgataattgttttgttttaggaggctaaatattggaccccaatcccttcttgtttgtaagctttctgttgagagatttgctgttaatctgataggttttcttttataggttatctgaagcttttacctcacagctcttaagattctttcccttgtcttgactttagataacttgatgactatgtgcccaggcaatgatctttttacaatgaattgcctaggttttctttgagaatcttgtatttgggtatctagatctctagcaaggccagggaagctttccttgattatcccctctaacatgttttccaaacttttagatttctcttcttcaggaacaccaattattcttaggtttggtcttttgacataatcccaaacttcttgggggctttgttaatttttttattcttttttctttgtctttattggcttgggttaattcaaatgccttgtcttcaagctctgaagttctttcttctacttgttcaattctgttgctgagactttcctgtgcattttgcaattctctaagtgtgtctttcatttccagaaattgtgattgttttttacgtttgctatttcattggagatttttccagtcatatcctgtattttttttatttatttaattggattttacctttctttggtgcgtccatgattggcttaataattggcttctgggccgcacacggtggctcacgcctgtaatcccggcactttgggaggctgaggcaggcagatcacaaggtcaagagatcgagaccatcctggctaacacagtgaaaccccgtctctactaaaaatataaaaaattagctgggcgtggtggtgggcacctgtagtcccagctactcaagaggctgaggcaggagaatggtgtgaacccgggaggcagagcttgcagtgagctgagatcgcaccactgcactccagcctgggtgacagagcaagactgtgtctcaaaaaaaaataataataataaaataaaataattgtcttctgaattctttttgtggcaattcagaggttttgtcttggtttggattcattgctggtgagctagtgtgatcttttcgggtgttaaagaaccttgttttgtcatttaccagaattgattttctggttccttctcatttgggtagactatgtcacagggaagatctgggactcttgattgctgttcagatttttttgtcccacaggatgctcccttgatgtggtgctcttccctttcccctaaggatggggcttcctgagatccgaactgcaatgattgttatttctcttccggatctagccacccagtggagcaactgggatctaggttgttactggagagtgtctgcaaagagtcctatgatgtgattcgtcttcaggtctgtcagccatggatgccatcacttgctccagtggaggtagcaggggactgaagtggaccctgtgaaggttcttggttgtatttttgttaagtgcactggttttatattggttggccttcagccaggtggtggcattttcgagagcacatcagctgtagtagtataggatcaggcagtgggtggatccatagagctcccaagagattatgtcatttgtcttcggctaccagggtgggtagagaaaggccatccaatggggcagggttaggtgtgtctgagctcatactttctttgggcaggtcttggtgtggctgctgtggctgatgggagtgtggtttccaggcgaatggagttattatagagactgggcaatttataaaggaaagagacttaattgactcacagttccacatggctggggaggcctcgggaaacttacaatcatggcagaaggtaaagaagaaagcaagtaccttcttcacaaggaagcaggaaagaaagaagagtaaaggagggacttccaaacacttacaaaaccatcagatctcatgagaactcactcactatcacaggaacagcagggggaaaaccactcccatgattcagccaccttccaccaggtcccttcctcaacatgtggggattatatgaattacaactggagatgagatttgggtggggacacagaatcaaaccttaccatgaacgaattctcactcacagttgctacaaaacaataaaatacctaggaatacagcttgctaggggggtgaaagatctccatagggagtactacaaactactacatgaagaaatcagagatcacacaattggaaaaacattccatgctcatggataggaacaatcaatgtaattaaaatgcccatactgcccaaagcaatttataaattcagtgctattcccattaaactacaattgacattcttcacagaactagaaaaaaaaaatgttttaaaattcatgtggaaccaaaaaagggcccaaacagccaaggcaattttaagcaaaaagaacaaagctggaggtatcaggctacctgatttcaaactgtactatgggggtacagtaaccagaagagcatggtactgatgtaagaacagacaaatagaccaatggaacagcatagacaactcagaaataagaccacatgcttacttaagatcactaagctatgtgatcttcaacaaacctgacaaaaacaagcaacagggaaagcactccctattcaataaatggtgctgggataactggctagccatatgcagaagattgaaactggacgtcttccttacaccatattaaaaaattaactcaggatgaattaaagacttaaatgtaaaactcaaaaccataaaaaccctggaagacatcctaggcaataccatttagggcataggcatgggcaaagatttcatgatgaagacacgaaaagaaattgcagcaatgacaaatgggacctaattaaactaaagagctctacacagcaaaagacactgtcaatagagtagaaagataacccaaagaatggtggaaaattttttgcaaactatgcatctaacaaaggtctaatatccagcatctataaggaacttaaacatactgacaagaaaaaaacaaccccattaaaaaatgggcaagggacatgaacagacacttctcaaaagaagacatacatgttgccaacagtcatgaataaaagctcaacatcacttatcattagagaaatgcaaatcaaagccacaatgagatagcatctcacaacagtcagaatggccactgtgaaatgtcaaaaagtaacagatgttggtgatgttatggagtaaaatgaatgctaatacacttttggtgggagtgtaaatcagttcaaccagtgtggaagacagtttggcaattcctcaaagacctaaagatagaaataccattagacccagcaatcaccttactgagtacatacccaaagaactgtaaatcattctataatattataaagacatgcacatgtatgttcattgaagcattattcgcaatagcaaaaacatggaatcaacctaaatgtccatcaatgatagaatggacaaagaaaatgtacatatacatcacaaaatactatgcacccataaaaaagaacaagatcatgccttttgcagggacattgttgaggctggaggccattattcttagcaaactaatgcaggaacacaaaaccaaatatcacatgttcttactcataagtgggagctaaatgatgagaactcatagacacatagagtggaacaatacacactggggcctataggagggtagaggatgggaggagagagaagatccagaaaaataactaaaggatactaggcttaatacctggatgatgaaataatctgcacaacaacccgtgcccctgcctgccatgacacatttacctatgtaacaagcctgcacatgtacccctgaacttacaatgaaagttaaatatatatatatatatatatatatataataaatgattatgatttattttggaggtaatggtgttgatattaactagacatgaccagagccaaggctctgcaaaatcatgaagtgtctctggtactttttaaactcctttttctgagtcaggcttaggtaaaatcattcccttcattctgtgccaaatgttggtattctattgattgtcaactaattcctgctaagcagctatttcttccagagagtatttatattttaatagaagtagctgttaatatcagatataggctccagttttgaataaagatagagactaaggtggcactaccctcctgctatgcctgtattttcctgatgacttgttctctccatttcaagatccccaaactcattgtaccaattagtctttgctgcatagcaaatttccccaaaacttgaaaaattgaaaacaaaaatagtttttatattttatgattctgtgggttagctacgtggttcttatgtttcatatggtattggctggattcattcatgtagctgctatcagcttggaacttggctggggacagaatattctgaaggacttcattgatatatctggtgtcttaacagggcccttaactggggagggtagaatcactgggggtcattccattgtctaagatgtctagttctctctctctgtcttgctttctcttcttattcattagttgagctttgagactttacataatggttggatctcaagagggcacatatggaagctgcgtaagtccagaagtcacacacagtcttttctgccatactttaatggtcaaagaaagtcacaggaccagctcaaattcaaggggagagaaaacaacctctatctattggtaggaagaaaagcatatatgaataagaatgtgatggctaattgctggccatatttacttacttagttacttagttttgagacaggttctcactctgtcacccagacgagtgcagtggtgtgatctaggctcactgcagccttcgtctcctaggttcaagcaactctcctgtctgagcctcccaagtagctgggataacaggcacacacaaccatgtctggctaatttttgtagttttagtagagacggggtttcaccatgttggctggtctggtcttgaactcctgacctcaagcagtctgccagtctcagcctcccaaagtgctgggattacaggcctgagccaccatgcctggccccatggccataattatagacaatctaaccttttattacactttccacctttttctcctatctttccttgtttatttttcacgtctctcctgacaatttcagtgatgtcactggtttctcaggttataaggagtgagtgttgtcatcattatttctaattcagtatgcctagtggaaaagacacaggttttagaaacatatagacctccaaatcaatgccgggtctacttatttctagcaatatgacactaagcaaaatatgtaagctcttttacctcaagtcttctcttctactaactaatagaggggacaaaacttaccccaaagggttaatattagatttatattaatatagtttatgcctagtgattaactgaaacttaagagatgctcaataagtgttactttatttcttcctgtttctacatgtctctctctctgtctcattttttttctgtcccattacttttcctagaagaaaaacatttttgaaaatttctaaccactgtttataacaaacatatttgtcgtaaacttactgataatgttcaaaaaatgcttcaagatgtattaagcattttgacaattactgttctcttatgctggatgccttattctttcctgagtttgccatgttattgctactactaagccttggctcatactttccttttgccaaataaactatcattcctaaatccatatgaaattttttctttttcagaagcattgtctaatgtttctgatggttattaatagtatttgtaaccttgtattttaatctatttgtttccaaaccgtttccatcagttttatgctccatgatgaatttgggggtcttttaaaccatgtatcccccactacacattttaaatttcacacactgtaaatagaactaaacaactggcaatttttcaataacaacatgttgaattgcacaaccagaagagcaataaaaatttgcttttagggccattttttctatgaaagattccagagacagcgttagtcaatgtcttcataaattctgtggaaaaaaatatataaatagaaagtaatagcaatgattagggacaagtgagtgattgcaatttttgaaaagaaaaaattgagaaaaacacattatctttcttgattcatacattattttgtgtgattagaatttccataaaagaaactcctaaccgatatttgactaagcattagaacaaaatagtgaataaaagaatcctatttctgtcatattattatgcttgctatggatacaatatgcagggactttttttcttttggtgggtgttgctggatgatttctttatttatgtccttgataaatactgtcagaaatatgttctaaaaagtaaataaccaaaggatagttcttaccaatccattagagattttatagctagtaccatttgtttggtctttctgtttctaaaagctttctttaataaatacatcactacaaatccaaaagcagaagtcagataacatcttcctcatctagataaccccaatatttcttttaagagttaggattccaatgtgccataaccagaagggcattccgaggcttccccacatttcctctgtttatggagacagctgtttcactaacttgcagctcttgtaaatgctttgaaagctgatcacatactatattcttgacttaatactttggtaagcctggatatatatctttctataaacctcacctaatctttgatattactataactttatctttgcttggaaagcacactcagaaggcttcatcaccaagattttgggagagtaaagctaagtgtagttgatgcaacattgtagaaacagcataggaacaataagaacaataggtaaagctataattatggcttatatttagaaatgaccacatttgatattttaggatatttttctaggtttttttcctttcattttattctcttctagttttgacattttatgatagatttgctctctagaagggaacgtctttctttaggagggtaaaactttggtcttagcattcacttttgctattccgatctacaactggaagatacataaaagtgctttgcattgcaaatttgggataacttcaaaaatcccatggttgatgttagggatagcactaagcatttcaattccaggagaataaaagaaattccgatttgaaatgaattcctcatttggagggaaaaaaagcatgcattctggcacaacaagatcaaattatggaatacacaagtggctccttcccatgtgcagtccctgtcccccgtccagtcctctgcacacccgaactgtttctgattggcttttagctttttttttttccttctaacacttgtatttggaaactcttctgtgattttgagaagtatgcttttgagtatttaatgaagtttttttctaaaagtaaaaaaaaaaggattgaattctttagcctattatgcaagatctctaataaattttgctgaaagtttactctcaattttgtctcccgcagcatccattacacaccaccacgcataatgtgtgtaatatttttctcaaatgatattctaacatttttgttcaagcgttctcagtctagaattctctttcttccataagcttggccaaaagtatgttttctaggctcagaccagaggccagtttctctattgattttttcattgttcttattctcccttataaatgtcttccttatattccacaaatacttccatttagtgctcatatgtaccaccatatcctcaattacgtctatttttccaaccatatatgatctagacgaagtcagaaattgttcatatgagcttgatgtctcacagtatcttccttgtaactgattgggttataaaaagacaatgaatttccagcacctattgtgaaactgttgtgggagtcatatttatttttgacatttaagttgaattgaagttattttaatattgggagcatcaagttattctgaaattgtgccatttgggggcattacaaacacaagatttgggaaatactatcaggaagttaatgcaaggagtaggaaaaccaaaatattccttttattcttaaccactaatagggtaatttttggttttgttttggtatcatatagtacaaacataggagggtcttcccatagtcaggacttcctaggcaaattttacgatatttttgtaaggaggaaaattctcatttcctcataacttatttaaatttagaggatcacctataggcaaaggataatcatgtattgtgatatgcctagttttttgaactacctttcaaagctaaattccatcaaacattttctcaattttttcttaaaatgtcatgttctctactgaagaagtaagattcaaaattgcagtatctgccatcttcccagaaagacataaatctccaaccaatgataccaaataataatcagttcactgtaggcagactatttcttacaaggtagtataaagtttttcaaaaatcaaaattcatactttgtatcattttctaatactggggggaagttttttttgagattttttcttataatctaagtttctggctttctgacgttggtaacaataatagctacatgttgactttgagaagatttagattttgagatggacttctttctttaattatttttatttatttatttatttatttatttatttatttattgttgttattattattattattttgagatggagtcttgctctgtcgccaggctggagtgcaatggtgcagtctcagctcactgcaacctccgcctcccaggttcaagtgattctcctgcctcagcctccagagtagctgggcctacaggtgtgtgtcaccacgcctggctaattttttgtatttttagtagagacgaggtttcaccatcttggccaggatgatcttgatctcttgacctcatgatctgcccgcctcggcctcccaaagtgctgggattacaggcgtgagccaccgttcccggccaattatttttaatttttatgggtacatcatagatgtaggtatttatgggatgcataagatattttggtacaggcatacaatgcataatagtcacatcagggtaaatggagtatccatcccctcaagcatttatcatttctttgtgttacaaacattccaattatacccttttaagttattgtaaaatgtacaataaattactattgattgtaatcactctgttgtgctatcaaatactggctcctatttattctatctaactatatttgtgtaccacggtgagtcttctatcatgatgaaagtaactgtaagtcaaatacaatgaaatacccagtctctgaactgttttacttgtgaagatccatattcaaaatggccaatatcagaatatttggtaggagaaatttttttaagtattagtactttaaggatgtatatatcacctatttttgcattacgttagtttttttttttttttcacatacacttcacgtgtgtgaactaaactgactcaagatttcaggcctacttccttagattgggcagtttcaggttcacttacagttctccagcccagcaataaacattgctttgcttttgttaaaaattctatcactacaaaaatctcccttttgctactcttttattacagtcataccaaccccatcaccctctaccatccctaaccctactactgctagtctgttctccatctacaacatttagagaatgctataatggaataatgcaatgtgtaacctcttgagattaactttttccactggacataatgccctggagatcaattcaagttgctgcctacatccattgtttattcttttttaagtctgaattgtatttcatggtatagatagaccagtttacttaacaattgtgcacagggcttcatgaggacatgctttcatttctctgggataattgcccaacaatgcaattgctcacttgtatgttaagtatacgtttaaggcttttttcttcaagaaattcccaacctattttttagattgactgtttttctttttattttttttcttttgttttgagacagagtctccctctgtcccctaggctgagacagtggcacgatctcagctcactgcaacttctgccctccaggttcaagcgattctcatgcctcaggctcctgagtagctgggattacaggtgcacgccaccacacccagctaatttttgtattttcagtagagacggggtttcatcatgttgaacaggctggtcttgaactcctgacctcaagtgatccgcccgccttggcctcccaaagtgctgggattacaagtgtgagccattgagcccggcatagagtgactgttttacttcacatttccaccagcaatgtgtgagagatccagtttctgcacatcttcaccagaatttgatactgtaactattttttattttagctgttgtgtattgatatctcatatggtgtctattgatatctcattgtagtctcaatttgcatgcccctaatggttagtgtttttaaacatcttttcatgtggttatttgctattcttatatcctctagtgaaatgtcttttgcttattttctaattggattgtttggttttcttattgttgagtattcagagttctttatatattctacatctaagtcctttgtcagattagtggtttagaaatatttttcccagtatgtaatttgtactataaatgtgctaatttgaagcttccatatactattaaaatttaacagtaaccgtgcaattgttttgaacctaaatcaacaaaagattttttgtttagaattgcaaatgcatggtaagaatacaaagctgaccaaatgtagttggatttattattgtttttaaatttctgcagacaacacttcccctgttgcctacacaggtttggagtgcttcccctgccctgactctggcagtatgctattgctcttgctagacccagagattagcaggtttttgtaacactctcatagtaacaaaattaacaatagactgttgtacaattcaatacgtggaaaatgataaaatatacaatccatatacttttctttaaaaaatgacaatgtattccagccaacagaaacaattcaaaattgtaaacttaagaatgtggaagatataaatttgtgtctttccttaacaaatttggaccagttatatattaatccagaaggattcttcagttcacagtgtaaacaacacccttcatcaattctctacatgattcctctttcacttgtagtcatttttgtgtatcagcaagtagtttttctggggcacactttttcccccacagttcatacaggaaattttttttaagcagcacttttgggatacaagtttatgtaaaggaataaaaggaagaagagtgggcagagggacatactgggctgcaatgcagttataagatatttgctgactccatgttcaccagcagctaaaactgggtgctctgcagagttgtctcgaattgggcagaggcccctcattacagtcccgtatggaccgtcattgaatgcaggatattctgggaagagtcactcacttcacctgagggaaattcataagtggactgaggcctaagaggtgatggttctggacaggtacactcgcagcagctatagactccaggcttttagtcctgagcaggcatctggccagtgtagcataacatgcgctacaactcagcaagcagaacctgtctttttatttcccatcacaaaagcaaagcttcaggaggtcgaggctatagcttgcgatgattgcacctatgaatagccactggactccagcctgggccatacagcaaaacctcatctttaaaaaacagaacaaagcagggcttaatttgtggccatttgcatttcaaaccttttaataatgattacatatatatatgatgtatatattcaaaatttatattgaataaactgagtcacaggcttttttttaattgagcaaaactaaaagtccagtctcatgttcattggcagatattttccccttaaatcctctttatatctaggatctataattattcctgtgttaattatgtttaagattagtttatatgaggtcagtgatgttaaaaaaaaaaaaagcctagaacaaagccaaaaaataaattcaccaaatgttaaattattactggaagatggtattatgaaagagattcatttcctgctttacactgtttttcacttctaaatttagtaaaatgcatatgtattatttttcatattcaaggaagaaatgtgtatatactatttaattgtagttaagcttataaaacataaatgcaataaaaatttggaaggaaatgcatgaaattcttggtattgaagctaatcaggcattctttcttttttatttttctgtatttcccaattttccataatgagtttaaattaccttcattctctctctctgaaatatatataatttttagattttagcctttttataagttacaaaaactgccacccctctaaataaggctgtttccttagttactgttgagtatttttaaagaagattccttctattgcttattataaagacctttttaaaaaacacaaatgtttactgagttatatgtaaaatttggtatttactgagatggtcatgtgttttatttttatttacagatctgctgaattatattgattccctaaaagggaaccacccttagcataaatgctacatgagattgatatatttttcttttagtgtacttctatattcagtttactaatgttttatttaggatttttgcatctataagtgaaagtagtatatgtgtgtgtatatatatgtgtgtgtgtatatatatatgtgtgtgtgtgtatatatatgtgtgtgtatatatatatatatatatatatatactttttatactcatctagttttggtaccaagttttccagagttgtagatgtattcagaaattttttggctcttttattctctgaagttgtcaaaagaattatttgttcctttaaagcttgataaccttgactttaacaccctctgaaataggcctcagagaggggtggtaagtgacatgagatggtctttttctctgcttctttccacattactggtctattcaaaatttttactactttttggaactattttggtaattgactcctgccctcaaagtattcattaaatctaaaaatagaactatgaaaatacaattttctacaaagtaattttataatttttaaagtcttccaaattcatgatcttgttttcattctgaatattatttgtgttggtcttattttttttccttggatacagttgccaaaagtttaattctcttatcttctttccatttaattggccaccttttagaaaaaaatgttgttttctgcttcatttatttttttgtttctataacctagtttactcttttttattgttttcctattaaattactatatttatttggtatcttaaagttctacatatttaacattttaaatatatagtttgtttcatgtattagatatttttatatcatgtattttgtaatagatacattttaggtattaatttttctctcattcatctgattacatccattgagtttggatatcaaatatgcctattaacattatttctttttaaaaacagtcttttatttccaaaagtctataaatttactaatttctcttaatataaaaaattatacaaaaatttagtaaatcaaaatagagtttgagccattatatggagaattgttttcatacacatgacttctattttttggaatatttttgaaattgcctttgcagaacaaaatcaactgttatgaatgttccatgagcatatgaaaagaagagaaattctttctttggtagataccatagatattcattaattatagataattattaacattaacattattaatgtattaacattaataacatgtaaatcaatgtattaacattccctataattttatttattttttgccaccacagctatcaatttctgagacagatgaagttacttcactgtgattttggattttcagatttcctgtgtttttaacgtttttcaatgctatataatttagaacataaaaatttataactttattgtaattttttaaagaggacttttcctttgcatcttgaactagaagtttctgcattgatatttaaatgggaacaagtgctctgtttttttaaaaagcatgttataaaagtagtttacaatgtaaaagtagggatatgagagaaagtggaaaggaaataaaacctaaaatgacaactggagagagagtatatttcagcgtatgacctttttagtgcaagaaagagagcaaaataatagaagaccctttctagcagagaaaataattcctgcctaggagagatccattttgacccaacatgataacacagataagtaaaaaaatcggacaggctcacagctcaatgatctattatttactatgttgagttggaaagaacatgtgatttcaagcaagttcattgagaattcaaatatcagccctcccacttactgtgtgaatttggacaagtacacaactttgatgatctttaggtttgttttatgcttttttttccctttcagttagtggaaaaactaatgcctaacaaagtgagtattaaaaaagaaccaagacaaagttcctggcataatgcctagaacatgatggaggttaagagaatattgctaatacatgatgttttgttcagaagtcctaactcagtggagtctaatcataactttaatttttttcctggaaattttcatctctcagtgttgcttagtaactaaaatggcttattaaattatcctgcttactgaccactacctcctcctcttgtattttactcatttaccttcattgacctgatggcaattgaaatcttcacctttttcatcactgaaagaaaaagggagggcctagattttctccttttactccgaacactcttactagataatttcataatcaactaagtgacaaagccaggcaacttttatctctgtacgtatttcaaatgtgccagctttgctccatgtctactgctagctaccactttagtctaagccttaccatgtttttactgatctactaaaacaggctcctgagtaatctcctatcaacttctgttgtctctttctaataaaatcacacattacaagtcaatttcttcttttgaaaactcaaatgttctcatgtcatttgaaagtttaaaatcttgctgttgcttcatgtgctccagcaccgtagcttgctaatctctgctctgttataggaaacaagaagagggtgagggagacagaaaaaaaaataaacacacacacacacgcagagagagagaggcgggggggggagaaagagggagttattcttcttattcaagtcgctacaaatatatattctaggctttgaaaaataatttaggcttttttatttgtttgtttcctaatacttttatcactgcacttatagtcaagagcaaaaattctagtgtggcttcaaaggcgctggatgagctgtctgacttctgcctaccttctagtttccctttttacctctcttccttcctttcatcatatactaactcttctggactttcttcagttcttcaaagatgctgaactcctttctgtctgagatcctcacaccttgtctttgctcctcgaccctatcttattaacaactattgattcttcagattttagccctcggtcatccatatcaagcagtttgttccctaccaccaccaccactaccaccaccactctgtataattttatcaggtttcactgttaaatggtttgatatcactttattattgtcctttttgtggtgaaataattttacattaaaaatatatatgaagtataaaatagtattacaaatcattatatacccccaatccagtttaagaaatacagctgtactaataccatttagtaaggcacggtggtcaactggatattgtattttctagcctcttgtgcagctggttgtagtcatgtgattacatacagttttacagcagttgtacatttctctaaacaatatatcatttagttttacatgtctgtgaatattgttaaaatgttgccatgttttctgtgatctttcattttttgcttttgtactcaatattatgtttttgagatatttctgttaataggaagacactgtttcattcatttcccatttatttcctatgtaagttcagtttaatggaattatgatattctaggtcattactatgcctgtatgcattgttttatatgtggacatttggcttatttctagttatacatacacagacacccatatgttatgtatatatgtacgtactgatgtgtttgtggtttatgtagatatgcagattagaaatattgctgtcaggaatattacagtaaagtagaatgattttcaacccaatcttgcatgagggttcaattgtgactaaatattttcacagaaaactttttttcttccatttagagtcaagactaacacagattattctttgacacttccctttgaggggaccttttctaagatgataaaattgcaattatttgatttggaaaatctgttattaattagatatctcactgagaagggaattggcttattgactgttgtaaatatctaaaccggttcattttgtagttagcattgtaattccacttgacattttgaagccaattgatatggtataagcagcctgttggccatacctacgaaatttctgtagagattgtctgaaaactctggctgttttcaagtttaaatatatttaaaattactccttgctggagtagtaattacattttcaaatgtagtttacaaagattctatgtaagtcaaaaaatttaacacacgaagatatgatcttaacttttcgcagtaacaatgaaatgtgctttgttcagccacaagtttttaaaaagtgtcctttttgatattattctgagtgttttaaaatctacttttagtgattcaagtctataataatgtagcaaattttattttcaatattctttcaagtatgtagcaaaggtgaatgctttttttaaaagtaacattcagttagacttttgcggtgaattaaacaccccatttgctggtcattaaagcatcccagagtggtgtgggaattttggaggtgggggtaattaaagtccgtgaaagacttggagtgaagtctcagatggacaggaattataatacctgttactctatgtgaaagtcgataaaaagcagcagtcccgaacactgattgaagtcactaagagacttggttctgtgtgtggaaagaagagggactcaagacctatctgacttcacataacgactctactcctgttactagatgtgtgaccatctaatgtgttattagaccttcagttttctcgtctgtaaatggagaataataatacttatttcataggatatttatgaggatcaattttaataataaatttggaagatctagaacagagcctggcgcacagtaggcatcagcaacagtcatatggcttccatgacatagcaactaaaccaaattatttttatgaaggggagatatcaaagagcttttataatagtagagagattttatgatgaagcttaaataaacagattttaatgtttttgtattttgcaataattgtgacatagattcaatttattttttttattttttttttaattttttttttttttattatactctaagttttagggtacatgtgcacattgtgcaggttagttacatatgtatacatgtgccatgctggtgcgctgcacccactaacgtgtcatctagcattaggattcaatttatttaggatgaaattgtatgctgaccatttgatcaaataatgactaaatatttcttaatgtaacataaccactttatttatttttcttgaacagtagccttttagaaagaaaataatatagctagatccttactttttgttactaaaatatagtgcaattggattaaaaatttaaatgttaaaactttttaaagtaagggcaaagtatattggaagaaacttgcatatatttttgtgtgacaacagtttggctatgcagggcataatgtctagacaccagaaatagaaggatatgtctgactaaaaccagtggcaaatccatacaggtctgcagcaaactcagtgcttgccttcttggaggaaataattcagccaaggggcagaagtaggtttaaggcagagggagagaccaaggcaagttttaaaattgagagtttattaaaatgttttagagcaggaatgaaaggaagcaatgtacacttggaagtgggccaagcatgtgacttgagagatccaagttccctgttcggcccttgacttggtgttttacacattggaatggttctagggtttccagttctcttttcttgattcttcttttgaggtgggctgtccacgtgcacagtggcctgacagcactagggaggggctgcatgcacagtgtgtttactgaagctgtgcacatgttcacttgaggtgctttcccttaccagtagtgcattgccagaggaaggttatatactggttaaactccaccattttgcctcttagtgtgcatgcttgagcccactccttcaacgcctaagatcaccagctcaggtgttttctatctatcaggagactatctttcactagcgctggctgtggccaattatcatttcagagagacagtttagcaaccaccagaccatcaactaatgtttgcttgacatttctggggaggtggtcctctcctgcactgttcatgtctgactaactacctactctaacatgacaacagatactttaaaatttgtaaactgcataaacaaattccaaagtcaagcaacaaattgggaacatttttggtggcacatatgatgagaaaatggccattactttcgtatacaaagagctattgcaaataaatttaaaaacactactttgattctaaaattgacaaaaatgaatagaccagaaaaatcaatacaaatgaacaataaatatttaaagcatgctcatccacactcatgatttttataatataaattaatatggcatttttcaattatccaaatattggccaatattcatttgatagtttatagttttggcatgtgtgtggtgaagcaggcacatctattcacttgctggtactgtaaattgctagaatgaaatttggaatatgtataccaaaatttacaatgtacataccactgccagtaatttatttactgaataaactcaaaactgtatgcatttaagaattttctttgcaggattggccacacagattttgacaaaaaatcttagataaatctgaatcttcatgacagtgaaatagtaaaattaataaggttagttataatcttaacatagtatgctattagccatttaaaaaatagagaactataatatgcaaatatggaatgatttacaagtattttaatgtgaaaaaagtaataagtaaacagttttcactgtaaacttacatttatgcagagaaaaaataattgtaaatgtggatatagggtacatattagaaatttttctggaaagaatgtttttaaatgttgagagtagaactagggatttcagtgtagaatagcaggaagaaaggagtaatacccattaatgatttcctgaactattttaaagttcttctgtgttcatgtacgttttactttaatttttaaaaattaatgcagtcaatatgatgataaaaatatataaatcataaaggactaaaattaaattaaatgtcattaggatccagcagattattgtaggtattggaaaacatgtacaatatgctcttgaaagggaactgtcaaaatgacattcttgaggtgaaatgatgcatgcatgtgtgtctaatgagttttattttcccccagacaaagtcaaaggaagatcaagagcagggacccactttgactcagcccggagacggagtcgagcagtcctttatcacatctctgggcacctgcaaagaagagaaaagaacaaattgaaaataaataacgtaggtggtatgtgtgtacaggatgaatgctagtgtttcccctggtggcaatgtttgactcgctaaagaaaggcctcaattacccatttattggcttgcctagatttttttttccactttggtttgtgcttttctataaagaacaaactggaaaaggtcagcagtcatgaggcatttctataataaaagtacttaatcatagtgttatcacagcatagagattagaatattattgcagtgaagtacaatatggtactagggacactgcaaatggggacgcactggttacattttatgaaacaaaaatgatgcagcaagtcgtattacacattcatagtttattggttaaaatttctcaaatttaattttagttccatctgttttgcatattatctagttctacaaatgcttttatccaggaggaacatgaccaaatcaaagtcattactccattaaaaaacttacattttatataaaacacagttgaaaatttcacagtaaaacactggatttacaattgcataccatacgttaaataatttgggaaagtcacacttctagtaaattacaatagagttgctttctgaaatatggtgtcttacctgtcaaagccacaacaaataactatgcctgtataaggagtttatttcctattttacatgacatatgtcttccaggatttcacactgaattttgtaattggttcttagcactaagacttcactgagaaacctagaacaatgtctctttagttgtagatactcaaagttttaagataatgttaatgtcattaatttgccttatggaatcatcagaacatgtatggggtgttgtgtgaccataggtggcagattaaataccagcatctaacttgccaatgacaagaaaaagtcacatgaaacaaccagatctattttggaatcgatttaagatccagaagttctgggagttaaggacagagaggggatcctttggcatttcatttttaacatagcaagctcaaggactacctaatccaacatacacatgctttgataaaacaggaccattcatcagacatacgaagtattcatttctgattgtagtgaacaaagaaagatgtatgagcccagggtgaggaacgagatctgacatgaaagtgctgcaaacctggctgtacttcagtgcaactttctggaagccaaaacaagatgttttgaatcatttgtcctccaaggaccatcaaccatgtccgtgctggtgtgccatgtaccactgtggtcacgctttgattttttttttttttggtcctaattcaatataaagtttctctagggatacctgtgccttagtgttatattgatttcctgggagtccagggagaggcttgaaacagtgcacaccacttgatctatggatccttccactggtgcctatttacatcccctttcagttaccaagtcagccttagtgacataagcaagttataagaagaaacaaaggtaaccgcatctgggcttgattccatgcaaatcaaccagcaaagcacctaaacaaatattatccacagattctgtaaggctgaaagctgacactgtctagcttttagtggagaatttaaacatagcaagtattagtgagctttaaaatgcatttgctgggcatgctatttttccctttagattcaacaaagtacaaagcagtacttaaaaatctgatttcaaaaaaactataactcccactacttagctaatttgcttaattgccattcatttaagaaatacaaacatcagagtagagcattaaaataatacatagtaatttaagatgcctaacagcccagtgactctaatactacaggtaatatcttattcctgaagcaaagtatggaatcaggacttgccctgttcacgtgttcaccatctcctttcaaggataacatagtagaatggctaaatggcagatagaaggaaggcagaagggagaagaggaaatgacttgtatagtttattgaataaacaataaattttctggaaattctggctgtaataacatttgcacacacaaaaaataattcttaacattttatagccctttgctatttacaaattccttttacttacatcatattatttgattcttatagcaagccagtactaggtctgatttttattagtcccattttaatgatggaaaaaaacacaacttattagaagcagcagttgtggtacccaacctttaatcttctaattcaaagccactgtgcttctgactcttaccttgctgcttctcggatacagttctgtggaacaggaatatatgcttcagccatagtcaaatgaactcgtcaggtcattagcaggtttgggaatcaggatgcaacatattttagtctggctctaactttgcctggtataccttgaaaaaggtgttttcaaattctgccttccttgattgttattctgtcaatcaaatgagaatgatatgatgcaaatgttttcaacacaaagaaatattaaagatcacactagagccttgaaaacttgaaaggagagtgctacaaatgcatttttctggcggggacagtggtgatcagcaaaggcatacactgggtttagattactcactgaagtgactgtagaaacattttcacattctcttgctcattcagatgatagtttcaaaggaactattgcaaaaatagtttaggaaacaattaccttaattaggcactggagttaactagtatgtttcaataactcataggtggaggttaaacatctaaaacaccattggtactaaagaaatatgcttgaagattaataaataagataaacttaacgtctagactaggcaaactccatgtttgacagttataaataacatgtctttccccctacttcctgctaaaaagcataattttacaattgtgtaccatttttttttacaattttaagaatttttttcattcaaaaggattttgataaaacattacaaaagctggtggaagaagagaagcatctatttttttcactcaggtgattatgtaaagatgtttgcaggatttgagttaacaacatttcaaaatttaaatctaatctcaaatgtattgaattctcagtatctttttaaaatatttttaaaatatgttctaagtagcttacaaaatgaaaccatgagatttattttctgatttgtacagaaaactaatatattgctgaacttttgtgacagaatcactaatgcttcatataatcagcataatcaaagacaaaaacaaaaacttcacttttgagttttcccaaatcattaccctagatatggatgttccctcaaacaatgtaaaattttaatttctgtaatacgatagaaaaaacttatgtggatagaaaatgagatatttcccatggcttctgataattctttattgtagtaaatattcagggaaaatttggattagaaccaatcatgttattacaacttgaagtgtttatcagtggtgagaagattaatggttatagaccttaattccctcttccaatgtaacagcccgaatttttatgagaagcccaacggggctacttcatctccccttctctgttttatgccaaagtctacctttggaactggtttcttgaaaccagagaatgagacaaaggagacaggacaaatatgagggaattgtatgaaacatagatgcagtggcaaatgggcatttaaggaccatctggaagtagtttaacagtgacccaccacgaagtactgacattatgagatgcctgtgtgggttgagtgagaatattaacaggaagtagaaacatgggttgaaaatacctaccaaagagaaatgccagacaggggtgcgttaatattaaggtagcagaactattcaatcactgacagtcaccacttagagctaaatgttcctgatctttctgaacctttcttgaatcctcaggtacttcaggatccctgaacacatcacattaatctgcccttccctcaatgagtgagacaagaacacaacattgtgacctacaagtaatatgtattcgggaatttataactgctctgttaattcaactaaactttcaaatataagtttccattacctatcttatatttcccattaattgaggtcaaagccaggtctgcaagtagctggtcacaggcttgtcaaatttccacacatgctattgttgggcctccctttgtcttctagcaacaagggaattgttcatcaatttgaactgcattcaaagtgaagtgcttttgcagttatcaaaaactccagctattctgcatttaatcagctgcacagtgaacattggctttctcctcccatgacttgactaataactcttaagcaactgtttcttactttaccatctgaataatgtctggcccatgtcagagtgcatctgtgtcagtcaaggtaacgagatttgggttcccaacttcaccaacagccacagtgcaaaaaatgaaagtagttagcacgacttggctatatttggaaagaaatgtaaactgtttacaatataatattggtcatatatctattctttttggaaagaaaagcaccattgctgtcatcagtaaaatatcaggtcaaatatagtctttagataatgactgtcatcagaaatctacaagtatacagaatgttctcatgacaataggaatgtaaatatagctttgtgtttataatgtgtgtagaattacatgtaactgtgaatgttttttgatgacattttaggtaatggtcttttttattttttaatgaacaaaatctgggttactcacttagcttcatgactaaactctgcatattcctgttccttataacaaagatctctgctcagttttagatgtttagatgctttgcgtcaccaacttttaaaagtcacttgtaagatactgctttgtgtagtgaatgatcctactcacaaaagtgtgtgtttcaagctatgtaatccttgtttctaatgttgtgtttctcctttctctcctttttgtcttcatccacagaatgtttttgtagataaaccagcatttccggagtataaagtttctgatgcaaaaaagtccaaattcatacttctgcattttagcacttttaaagctggctgggactggcttattttgttggcaacgttttatgttgctgtgactgtaccttacaacgtttgctttattggcaatgacgacctgtccacaactcggagcacaaccgtcagtgacattgcagtggagattctttttattataggtaagaacaaacagctgctttcctacgatatttgcatatgagaagtgaagtgtgttccagatttttctgacatgaatttgaactaagatccatttgcatgggcttgattcagcctctgttgcaaattttggagaagcacatactgtatttggatttctgaaaattgcctcttccaacttttcctgtccctttattcaaacagatctaaactgatctcctgtgtttctatacttatttcatccagaatgggctaaaaaagatttaacagctgttttgtttgtactctcacatccttcatgatcttaaactggtagggtcagagatgggtttgacaaaaacccaccagtggtgttgtgacagtggtccactccttgacgtgttctttctccatgcccttccgtgccctttcagcatgttgatggtttcaataaatgacctggttgcagaaacaaagggttacataagccttgcagtaaatctggagaagcagtgagtatctgattttaattaaagaaaaggccccaaaggatgtttgttaagataatttatcactagaatattgtgtacctcagttgaagctgcgtctgtgccaatcttgtaagccttttcctattttcctgtcccttaaatcttcatcttgtttagaccaaagcctagctctggcttgctcattctaggacagattccgggtctgtaagtcacagattgactccctgttgagttattgactgtcattagcagctgatacctgcttctttccttggtcatggtgatagagggctatattcttactgtaaagatgagaggatgtttggaaacattttcaagcaggtaggtgaacaaaggagtgagaaatggatcttaaaatttcaaagaaaaataaataattaagtgaggcacatcaaaaccttggttcaatggtggtagtagttgtttttttgtgtgtttttttggttttttctcagtgaagctgttaaatctttgaggctagagtgcgttttctggttgaatgtcagcacgtttgctttggatgagtttgtgtgctcttggtatggcttggcatcgttattaacattgtgtctactgggcacacccttcagagccttgataggacctctgctgtcaccccagaagtggtagctatagtgtgtttaggccactagatggcaatgttgtctagttaggcagacggcaattttatttttaatttttttattttaaaatatagctatcctttattagaaagatgtaaccataaagggatctattaaataatggttaaatggaaaataacattccagtttgaacaagaatttaaaatgaaaatggtagacagattgggtgtgtctgtggttttgtatccttttactttgccaacatttgaagtctcctcccacccacccatgatgcacacataaattagcatcataaaaacactccccatgccctggtcaaagttctcaagaacttgggcagtcactcaacatggctaagccttcgttttttgtagtagtgatttcatagggttttgtgaaataatagatgtaagtatctgcttaacaaatacttcatcatcttattgttatttacaactttgttattaggtcaagttatatcttgaactttcctttccattcttcctggttcttagatatttgacattctttggccttagaagccacttctgttaccacatgttcattagcagatgatgactgacttactcccataaaaactcatacctttgacggagatattttaaaagtttttgtttatttgttttaaggctgcttttctctactaaaccaatggagactcatttgctcccctgatagcaacccctaaattcttctgtgttttttattactgtcatttcgactgtgcttcagcagcaagatggttctcccagtaggcaatacccatcccttactagctacatgcaaaggaatgaaaacccattccaatttttttggtgtttactttctgcaaagatttaggatttgaaattttggtctgcaagcagttctagtgtgactcctgcctgaaatctcttgttgaccaacttatttttataagcagtaaaaactttcctattctttcctgctgttatctgcctgctctttcttttaaatgagtttaagcatatctacaatttattatagcatatttagaaaaatggcttaaattaatatttctctgtttccctaaacctttattctataaaatatttcaaaaaggtggcctaaaagtgatcattgagaaataagttaaaatactggggacaaaatagttgcctgtaatattgcctgtaatattgtatctttacaatgtgaaggtagtgttcataccatttaatatttattaaattactgcagacttaaacttccctgtctgacagctttgaagagaggagcagttctcccagcatggagtttgagatctgagaacggaaagactgcctcctcaagtgggtccctgacccctgagtagcctaactgggagatacttcccagtaggggccaactgacacctcatgcagctgggtgcccctctgagacgaagcttccagaggaaggatcaggcagcaacatttgctgttctgcaatatttgctgttctgcagcctccgctggtgatacctaggcaaacagggtctagagtggacctccagcaaactccaacagacctgcagctgagggtcctgactgttagaaggaaaactaacaaacagaaaggacatccacaccaaaaccccatctgtacgtcaccatcatcagagaccaaaggtagataaaaacacaaagatggggagaaaccagagcagaaaagctgaaaattctaaaaatcagagcacctcttctcctccaaaggaacgcacctccttgccagcaacggaacaaagctggatggagaatgactttgacgagttgagagaagacggcttcagacaatcggtaataacaaacatctccaagctaaaggaggatgtttgaacccatcacaaagaagctaaaaaccttgaaaaaagattagatgaatggctaactagaataaacagcatagagaagaccttaaatgacctgatggagctgaaaaccatggcatgagaactatatgacgcatgcacaagcttcagtagccaattcgatcaagtggaagaaggggtatcagtgactgaagatcagatgaatgaaatgaagcaagaagagaaatttagagaaaaaagattaaaaagaaatgaacaaagcctccaagaaacatgggactatgtgaaaagaccaaatctacatctgattggtgtacctcaaagtgacagggagaatgcaaccaagttgtaaaatgctcttcaggatattatccaggagaactttcccaacctagcaaggcaggccaacattcaaattcaggaaatacagagaatgccacagacgtacacctcaagaagagcaactccaagacacataattgtcagattcaccaaagttgaaatgaaggaaaaaatgttaaaggcaaccagagagaaaggtcgggttacccacaaagggaagcccatcagactaacagcggatctcttggcagaaactctacaagccagaagagagtggggaccaatattcaacattcttaaggaaaagaattttcaacccagaattttatatccggccaaactaagcttcataagtgaaggagaaataaaatcctttacagacaagcaaatgctgagagatttttgtcaccaccaggcctgccttacaagagctcctgaagaaagcactaaacatggaaaggaacaaccggtaccagccactgcaaaaatatgccagattgtaaagaccatcgaggctgggaagaaactgcgtcaactaacaagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtattcaggagacccatctcatgttcagagacacacatagactcaaaataaagggatggaggaagacctaccaagcaaatggaaaacaaaaaaaagcaggggttggaatcctagtctctgataaaacagactttaaaccaacaaagatcaaaagagacaaggccattacataatggtaaagggatcaattcaacaagaagagctaattatcctaaacatatatgcacacaatacatgagcatccagattcacaaagcaagtccttagagacatacaaagagacttagactcccacagaataataatgggagactttaacaccccactgtcaatattagacagatcaacaagacagaaagttaacaaggatatccaggaattgaactcagctctgcaccaagcggacctaatagacatctacagaactctccaccccaaatcaacagaatatacattcttctcagcaccacatcgcaattataccaaaattgaccacatagttggaagtaaagcactcctcagcaaatgcaaaagaacagaaattataaaaaagtgtctctcagaccacagtgcaatcaaactagaactcaggattaagaacctcactcaaaaccactcgactacatggaaactgaacaatgtgctcctgaatgactactggatacataacgaaatgaaggcagaaataaagatgttctttgaaaccagtgagaacaaagacacaacataccagaatctctgggacacatttaaagcagtgtgtagagggaaatttatagcactaaatgcccacaagagaaagcaggaaagatctaaaattgacaccctaacatcaaaattaaaagaactagagaagcaagagcaaacacattcaaaagctagcagatggcaagaaataactaaaatcagagcagagctaaaggagatagagacacaaaaaaaccttcaaaaaatcaatgaatccaggagctgtttttttttaaaagatcaacaaaattgatagaccactagcaagactaataaagaagaaaagagagaagaattgaatagtcgcaataaaaatgataaaggggatatcatctccaatcccacagatatacaaactaccatcagagaatactataaacacctgtactcaaataaactagaaaatctagaagaaatggataaattcctcgacacatacaccctcccaaggctaaaccaggaagaagttgaatccctgaatagaccaataacaggctatgaaattaaggcaataattaatagcctatcaaccaaaaaaagtccaggacagatggattcacagccgaattctaccagaggtacaaagaggagctggtaccattccttctgaaactattcaaatcaacagcaaaagagggaatcctcccttactcattttatgaggtcagcatcatcctgatatcaaagcctggcagagacaaaacaaaaaaagagaattttagatcaatatccctgatgcacatcaatgcaaaaatcctcaataaagtactggcaaaccaaatccagcagcacatcaaaaagcttatccaccacgatcaagttggcttcatctctgggatgcaaggcttgttcaacatatgcaaatcaagaaacataatccatcatagaaacagaaccaaagacaaaaaccacatgattatctcaatagatgcagaaaaggccttcgacaaaattcagcagccctccatgctaacaactctcaataaactaggtattgatgggacgtatctcaaaataataagcgctatttatgacagacccacagccaatatcatactgaatgggcaaacactggaagcattccctttgaaaactagcacaagacaaggatgccctctctcaccactcctattcaacatagtgatggaagttctggccagggcaatcaggcaggagaaagaaataaagggtattcagttaggaaaagagaaagtcaaattgtctctgtttgcaggtgacatgattgtatacttagaaaaccccattgtctcagcccaaaatctcgttaagctgataagcaacttcagcaaagtctcagaatacaaaatcaatgtgcaaaaatcacaagcattcctatacaccaataacagacagagagccaaatcatgagtgaactcccattcacaatggcttcaaagacagtaaaatacctaggaatccaacttacaagggatgtgaaagacctcttcaaggagaactacaaaccactgctcatcgaagtaaaagaggacacaaacaaatggaagaacattccatgctcatggataggaagaatcaatatcgtgaaaatggccatactgcccaaggtaatttatagactcaatgctatccccatcaagctaccagtgactttcttcacagaattggaaaaaactactttaaagttcatatggaaccaaaaaagagcccgcattgccaagtcagtcctaagccaaaagaagaaagctggaggtatcacgctacctgacttcaaactatactacaaggctacagtaaccaaaacagcatggtactggtaccaaaacagagatatagaccaatggaacagaacagagccctcagaaataataccacacatgtacaaccatctgatctttgacaaacctgagaaaaacaagcaatggggaaaggattccctatttaataaatggtgctgagaaaactggctagcaatatgtagaaagctgaaactggatcccttccttacaccttatacaaaaattaattcaagatggattaaagatttaaatgttagacctaaaaccataaaaaccctagaagaaaacctaggcaataccattcaggacataggcatgtgcaaggacttcatgtctaaaacaccaaaagcaatggcaacaaaagccaaaattgacaaatgggatttaattaaactaaagagcttctgcactgcaaaagaaactaccatcagagtgaataggcaacctacagaatgggagaaagtttttacaatctgcccatctgacaaagggctaatatccagaatctacaagaaactcaaacaaatttacaagaaaacaatcaaacaaccccatcaaaaagtgggcaaaggatatgaacagacacttctcaaaagaagacatttatgcagccaacagacacatgaaaaaatgctcatcatcactggacatcagagaaatgcaaatcaaaaccacaatgaggtaccatctcacaccagttagaatggcgatcattaaaaagtcaagaaacaacaggtgctagagaggatgtggagaaataggaacacttttacactgttggtgggactgtaaactagttcacccattgtggaagacagtatggtgattcctcaaggatctagaactagaaataccatttgacccagccatcccattactgggtatataaccaaaggattataaatcatgctgctataaagacacatgcacacatatgtttattgcagcactattcacaatagcaaagacttggaaccaacccaaatgtccatcaatgatagactggattaagaaaatgtggcacatatacaacatggaatagtatgcagccataaaaaaggatgagttcatgtcctttgtagggacatggatgaagctagaaaccatcattctgagcaaactgttgcaaggatagaaaaccaaacatcccatgttctcactcgtaggtggcaattgaacaatgagaatacttggacacagggtggggaacatcacacaccagggcctgtcgtgcagtggggttaggtgagagggatagcattaggagatatacctaatgtaaatgatgagttaatgggtgcagcacaccaacatggcgcatgtatacatatgtaacaaacctgcacattatgcacatgtaccctagaacttaaagtataataaaatatatatatatatttactaaatcaatatgtgtggtaaaatttacatgtatatttaacatactgtttattttctatttctggagtagtagtattaatttggcatcttataatcaattagggcacaattgttaaaaagtagtacaaaaagggtctaggaaggataggtgttcatagaactacaagatgatgttttaaaaaatattttggtattcacgtaaactccatacaaaagtataaggcaatatgattattttaaattgagaaataaatgtttcatgaagaaaggacccacagtcaattttgggagatgatatatctcttttggagagtcacaatacactttggcactgtaggtcttctgagaaatttaatgataaagaaatttatttaaatatgattaatccagcatctctcaaatttatttttacctcagaactcattcttccccagaccacttagtaatgctcttttggggagatagactcaaaaacattcttcccatgtagatttaccataaagaaagtgtctgattgtaattatgctagtcaaaacttaaatatgaatggtgaatctctactaggctgtactcttactcttaaattaaattcttttgtaagccacattaattatttgggatcaacatggtgcaaggttgcctgttagttacaaagtttggctatatagttacctttagtttgaaaatcatcctatttaattaagctgctgattcaaagccttatagaaacttaaaatgagaagtgactgaatagcattaatcgaatccaatctttcttacaccacagttggagaactgtgcattagtgatttgcccaaggccctataactaactgatggcagactcaggccttctggttgttggatcaggttttttgcttgagtttacagttaatatgattctattttctgaaaaaatttcactcaacttgcttttctttatttatggcaatgaggcagaaaatgagaaaaagaaagaccacctccttttctttcttccacgaatatggaaattaataatttgaatttgtaatcttggtggtgaaaactgctgtgtatccataggttcaacagttatcgctcccattttcttactgaaaaatttaaaaaaaagcaattttttgtaggcagcagtatgcccagattcagggaataaattatgactgttctaaaccattgctaatttcattccctttatctcacttcctggtgtgaagatcagtatgtgaccaagtctatccaacaggatataaagagattgttttggtggggagaggggagcttcttggaaataattcttttccctgataaaaaaaaagaaacacatgtaagggaaaaatatttgcatccccattccttcatttccactgggatgtgtagatagaaggagatggtgtttgaaaccactgcagctgtcttgttatcattcagagagatatggcaaagaaaatgtggatggccaagcagaaagctgagacattgcatctccagactcctttttggatgatataaaatgttcctattattggagccactgttaactgagtattttgttactaatcatcatatcattctaaaaatacaaaaaaaaaatcacttgattgtttgcggccccttttactgggccatttcaaaggctctaagttatattctttcaaaggaaatagaatgtccttttttacatcttgtcattttactgtgagactaagaagtgatttgcacattcttactatctactattataaccacaaagactgagagtcatagattatgccataaagttgtatctctgattgctttggtctctctaagaactcttcagaaagctaagtgtcaaaagtaacatgatatgcaagtatgctttgtttatatttaccttagtcaaaaaatcactgagttatttaacaggacatctgaaaaaacaggatagcgtaatggggaatatataaataaagggataaagctgagaagctttcataatagaaggaatatatatatataaatcctgagtccaaaagggcactttaggaactgaatgggataaaaaatacatatactccatacctaaacatgttactgtgcagattataaaggattaaaaagaaaatcttcaaagccttctgaaagagaaaatttacttaccaaggtataataattagactgaagtcagatttctcagcaacagtagaggccaaaaggcaatgaacaatatctggcttactagaaaaaaatactggccggccttccttccttcctttcttccttccttttcttccttccttccttccttccttcttttttctttctctttctctttccttctctttctttctttcattctttctttctttctctctctctttttttccttcttctctctttctcctcccttccttcctctcccttcctttcttttctttctcttttttctttcatttctttctcttggttcattcttcttgaggaaagggtacacaatgaagatattttcacaaaaaataaaactattgtaccacccacagattctcactgaaagaactactaaaatatgttctttagcaggaagaaaagtgaagccagaaggaaggagtggatccaagataaaacaaaatttgaaatgaaaattgataaaatatgttgacaaattagattaaccattgggtgaaaataaacaatattgtttcaatggactaaataaaaacaagttataacagatactgctaaaacatgttgataaatttaattaactattgactgaaaatatattaaggtgttttatgttttttaaatacatagaaaccaaaattctaaacagtgatgaccatatggaggtgatggtaggtggctaaaaagcagtgtgtcaccttttaacatgtccagagtaaatacattagaacccaggaaatattgttagaaaactttgtaattagttgtgtgtattaaaatttttaaaggaactgtgcaaaaataaaacaaaaatattaatggacccagtgatttcaaaacaaccagaaaaaaaaacctaaggaaatatgaaatattactaatccacaaggaaaaggaaaggagaaaaacaaatgaggaagacaaatatggggattagaagatgaaaaataacagcagtaaatcaagatatatgacaaatattcaaatgtaaacacttaatgggtagtaactcacatgctaaaataagtgatagtcaatggattttttaaattcaaaaatatgccagttatagaattaaatctaatacaaaattactagaggaattggaaaaaagatctgttatgtaaatactaaccaaaagaaaagaggtgcaagaatataaatagctgagatataaaatttaagacgaagatactaatagggctagtaagtaatattatatgttaataaaagaaactattaagaagatataaccataataaatatatgtacttatatatatatgtgtgttgtgtgtgcatgtgtatatacatagagaaagagaaacttattttagaaaataaaaatagctataataacacgcagtatcagaaactgataaactagcacatcaatatttttagactataggagatttgaaaaacgtgatcgacacctgatacaatatcgtttaagtagaattcctcaaccgtgggacgactgaagtttggggctggataatcgttagttatggaggctgccctgtatattgcaagatgtttagcaacatctctgatctctacccactaaatgccagtagcacccactgcccagttgtgacaatcaaaattgcctctagatgttgccaatttatgcatttattataatttccaagacatattgtgaaatgaaataagcaagattagttgtgtatatatagtatgctaacgtttatatacaaaaggggtggggaaagagtatgtgtgtgtatatttacttgacaatgcttaggttgtctttggagatttaaataagatattgctgagcttctttgcttccagagagaaccacaaggtactgagcacagaaaagggaagattttactggataccttctgtgaacttttgagttttgagcagtataactgtaatgccaaatagagaataaacaaaattagagtaaaaaacatacatataagagttaagtgattactccagaatttttaaaaagcatgagcaaaagcctaaaggaggtcataaagataaggacagaaattataccctagatagcaaatgaaaataagaacaatgtggcaagactcaatcaaatttgaaatgcacataccctaggattcagcatttattcttttttaggtggagaatcacttgcagacatgtgcaaaaggtttgctgggttattgtttgcaggagcaaaataatggaaacaaagtctatattcaccgaatagtagagtataaatcaagtgtggtggatgggtggatgtatataatgaaaaactacacagtagagaaaaaagaatatagagcagggattggcaaaccaagtgtcagaggccaaatctttctccctgtttttatagataaaagttatcgttaacacaattactcatattcttttgtatatgttttattgttgcattcccactatatcagcagagttgagtggttgcaacagagactgtggccaacagagcctaaaatcttcacaatcagtcctttaaacaaaaagtttgccaacccctggtctaggacaatgttttctaacccaacattgccttttccataacaaatattttataatgccttcttattctctacctagtcatcttaaaaataaaattgatacaattttatatatctctgatactgtaatatcagagacaacataaaagaaatcatttataataatttcttgtgtatttcaattcataagggctgtagcgttaggatactaaaatgcataatgagataaatacttgcagttagttataatgaacaaacttggatttacaataattccattgaggaagtacaggcaaattaaaagagtagaggtacaagtggacatagaataagaactagtattatgatgagtattcatttaagcagacattaatatatgacaacagaaattgggaaatagctaactcaggtaaggatagcatgctaagacaaatttcagtctatgaaaatagaaaaaatgaggaaactgagtcttctggcaaatttgttggcccttatccctatatgtagtattctaacaattcctgtgctcagacctggagtgagatagtgatgaaatcaaaataaataaataataacaggagaaacatttgagtggggaaaaacaacaagaaaaagaagtcatgaaattaagttttcctaatggtttttcaatagaatcatggatttttttctctcatgtatttcttcattatttaaaataaaggagatcccacatttttctgcccaaacagttgaaagtcttgtggagtaaagggctatcacattgggtagattatcctgtccaggccagaacatctcacgtccttgcccactacacaccagtaatgttcccaatcattataactcaaaatactccatacatatttggcatttatattcaatgctgtattttgaggttatttcctacatccacttgagtagttctagtttgccgattctcagaggagcaataccaaccatgggagatactttagaaacacatgggtttgactttaactcaccaatcggcattactattatttggtatagcatttgtgcttgtaataccaatttacatatttgcaaatggagtaaaaattaaacaaatgagcagaattcccattggtgcagcatttcttataagcatatatacacattttcattgtttgtaattattttttctccttttgcttaaaatgctttattaaccaatacttctattaacttacaaatacccaaatttttctatctcagaatctttatttctgaacatcatttaatttttagtattaactttagtgacataattagggcaggtatatatttgtatacataaggagaaagggagggaaagtaagaagttgatacaagatctggttaattactgacgaagctagagctaaaaccctgaatgtttcatttgtaaatgggcaaagaagtagcattattgtgagaatttggtgaggtaattatatcaagaaatcagctcactcactgttcaatcaataatgatgattattgtcgataatgtaggggaggaaaatcttccttctatcttcttagattctgtggctgagaattaaactaatgtaagacagactaacagggcaaaaaagcatacaaattttattaaatatttttccatacacacaggagtcttcataaagaaaataaaaatccaaataagctgttaggccccaaagcttaaatagcttttttaaaaatgtgttaaacattgtgaggatgtgacaagacaggggaagtaaattgtggggcagtgactaggaaatatatgggggaaattaatggaggatgagttgttttagtagattggtttgtccagattcatctcagcttcaactcccagtcttcagtgataagaatgttcttttctttctgatatggggaaagcacctgtctcatgggaaattttatgatttgcatttagaagagggtcagggaaactttcctgcacctgctgtttctcaaataccttcagctataaataatcaatataacaaagcagcgtatcttgaggtggcatgttcaaggtcatcaagcctgtatttcctcagtatttgtttttgtttttgtttgttgtttgtttgtttgagacaaggtctcactctgtcatgcaggctggagtgcagtggcacaatcacagctcactgcagcctcaatctcccagggtgatgctcctacctcagcctcccaagtagctgggattacaggcatgtgccatcacgcctggctaattttgttgtttttttgtagatggggtttccccattttgcctaggctagtttcctgagctcaagtgatcctccccccttagcctcccaaagtgccaggattacaggcatgagccactgtgcccagcctccttggtttgttttaatatctactgtttttagaaaattagcatcctttgaaacatacttaataatccagctaatcttgggactaagatacaccagaacattgcacaactcaaagctttcaggaacacaagtgtctgaggattcatttactacttaaaggagcggaggctttttcaggtacttatgcagacttggctcagcatctttctgaaaagccaagagaaggtctcttaaagaccatcatcttgtatctacctgtcaggcatcctttatctgcagtactctagggactgacatgcattgaatgatgtcaaacaacattagaagtaatcattccagttatcttctctcttccaatcttccatcagcacttctaagaacaaggaaaagagctgatcagcatttcagctccccctccttttttcctgaacagctctgaagaggcctgaaaggcacaactgggacttccagtaacacagtctagaagcaagtcattagctaaaggcttaatcaccagcttgagtattcaagaggtctcttaacaacagcttcataattttgctggatctgagttcaatatttagtatcatttacaaatacatacttgcttcaaaaaacttttctccaaatctcctctttattgtgcataacctatataatctccgtttcgtgttaaatggaactaaggggtagtgctcttgtaccattgaactctactcatatcaatgcttgttacactagtagcccccaaaaaggtactttaattctaggattcttggatgtctttttctatcagggtaaatacacaaacatcagtgggccctgaaagggtatggactttttaatgttatttcattgtataagcaaatcccaatttatagtatagtcattttcctgaaaactgcaaagatgtcatttcctccttaggtaaaatggctaaaattaaagatactgacttggatactgaaggcaaagacatctaataataaataaagttgaagttttatgatgaggagaaaattaaattaaattttacccctgaattgcttggacattctggtataccctgactacatagttaagctttgattagttaacatccattcgtctcttagtgtttggctccctctctcccttcctctcttcctctttaaatctcatttttcctcctcccctactactaacatagtcagattctcccacctattcctagtacaccttttagatataaggtggcaatggaggtccgtatacccatatacccccacgtcttcatgcccacgcctccacaacacaaagccttaagcgtgttgaggagactccttccagttattctgtttagccattcacgctaatctaggattgagtaatagggtctctcactaacaatgactcaatacggcattcatggctcggatttgacctttgtcccacaaagctatttataatgcagctatgagaatatttacagtgtctgtatgccaagataatatatttggaacatttattaaatggaatgtattatattgagcattgatctttgactagaaatgaatcactgccgacttggttactggccagctattttttggtgaataaatctaagcctgcgtatatagcaataattatacaaaaaacagaaaactacactaccacttcagattcccagtgaggtgtaaggtagtaagtgtcttatctcaaaaatgtagggattttacatgtcagaatatcttggtgggaaaagaccgtgcattgaaaagtaaggtactgttttcatcattcttattaagagctctcaaattaggtgactttaaagtacctacttaagcacttaagcaaagattaaaattgcatttgttttacaaatcaactgtcagttcacgtattgcttcattaggcttttcagaattcactatgggaagatgaaacgctatcataaattaactattgaacggatacccaggatgtgtaaccactacattttccttaaccatatgaaactgcagagcagactatttttcatttgattgtttcaaacatagcaatggatgtttccttaggcaagatgtaataggcttatgtttaattataagaattactttattcaccatcactttctattagacagacttacagatttttggaaataattccaccattctttactgtaagcaaaatcatactcaaggacaatgttctcgataaacctacaaattacattttaaggtattttcttgtgatttaatgttcctctgtgcatatactgtgctaattatctaaactttaaaatagaagcagtggagaaaaacaaatgtctgtcaattacagccattccaaaacaatgtctgcttccattttaaatctttctgtgtgttgttttctctacttgttttaatgtagttgtgctggtattctatgcaaacttggggaatattttttctcataacattttaatataattatttctctgtgttttataaatatttataaacatatttaatatctgcataatattccatcatataatgattatttagtttatataaccgcatcttaattgttacgcatttaagatgattttgattttttgccacttaaatataaaaatcgtaatgaacatctctatgaaaaatatatttatttactaactaagcaaatacgtactgagtgcctatcatttgccatgtactgttctagatgctggagataggccagtgaagcaaatagacacaggttcttgccttcatatgatttacatcctgataggagacaaacagtaaacaaaacaattaatttaaatggcatgcttgatagtgacaggttgcacgtagaaaaataaagcaaagaagggggaaggaatgggctgcaattttaaatcagtggccacgcaaagtataattgagaatatgacatttaaataatgacagaagagaaataaagaagcaatcaactgtatctcttgatgaagaacattccaagcaaaggggacagccagatgctttactcccacatttggagttcttttaagaagcagtggaattattgggccaaagaatgttaatatatacagcttataacacatctttttttaaaaaaattacattatccttcgagcatttttggtcagtgaagctctagttgaaatgccatttgtccatgctaatatttccatagtaatagctactgtgaaatattataggttgtatgctgctttctgaattttttatactagttaaagtcgcttaatttgatggagtaattcagatactataatattcatattgcattattgttacttattcctattttttccttaggtttaatgccacaaggaaaatgaagttgtatttgtctgatggattcaaaacttatttcacagtgtacctgaatgtttaaatttgaaatatttgagatggcaaatatgaaggaaaattgtcttagcatgtgtctgagaatgattctgccttatgacatatattactgtaaatagactatgagaagagcatgtgctcataaaatatgaaatagtggtgcttgttttgaacaaggcagggatattaagaatggaatgttactaaatttagaaacccaggagaaaattgtgagttcttgatttagaaacttaatgtaatgaaagggtttttttccctcttaccaaacgagttctgctatgtcattctctcttctttccacttttcaagtatgttttcttaaagtataaaaaaataaaataaaattctactctcaaaatagaaaaggcattattcacatggtttgtattttccatctcagtccatggtgttagcatttcctattggaataacctcctcttcccgtcactccaatagttttaagatcagtaaatacataagtaataaatgataaaaacaaatatatattgaatatagtgaaaagttatttaaatatttttagatgacagaaaacattctggctacctgtgtgtggatgtaagtctttatgtagtcaatgtattaaatatttgttgaggaccaaaatgatgtcacccaagagagctgatgtggcaattacttagaagcatagaagacccttcagggtcttgactccttatttctatccttttctccatcaccacttgctcctccttcttgtggctccagccatactgaccatttgcacttcctcaactgtgtcattcttttcacctcgtttcatgatctttgcactttctactcccagaaaataaaaatggcaagacatctccttagttcctctttacgcaattaaatttttcttatccttgaagtatcatctgtgaactctctgtaaagccttctttattccttgttaccccgattaccatgagtctgggttaggtttctatcatgcactatttaacttatttccttcctccattctttaaccccgtattataattgtgtacccccactctctctctctctctatatatatatttatatatatatcagaaatatatatatcataatatatatatatcagaaatatatatatcataatatatatatatcagaaataaactttgagctctcagagaacatggaccaggcaatacatttatttttcaaattccaccaacaaatatagtatttaataacatatttaatatttgcataatattccatcatataatgcatatgtagcactaaacatatgtctccttaccagcatagttcagataaacaaaatataacatgtagctcattgagttgaacaacagccttatttccaaaggtttgtttgtttcatgtggcctcacaggtaactgattttgttttttaatttttaaacagcacagcctactttagagttgctaattcttaacaagtcatgtataattaaacaaagagcaggtaacttgggaaatcctacaggttttggcgctgggcccagacccttgcaaacacatcaaggtcttgtcaaggacccctttactgttggcttacaagagagagcatgggattagcccagcaaatctaaatgctaggtgttaggatatcatcctttcctggataacaaccctaaaagggagacttatgaccatacagaggaccaaggagatgctgcagtctcaactcaactagacatactggccaccaggcaattaaaaatctttcttatcaaatagctaataaaaattatctaatcattgctaaatactttaattatatcaggcctgatataaatctgatgccatgctttgggttatgaaaagcatattgaagaagttgaagacactctccctgtattcaagaagcccatacaatgattagggaaatttgtctaagcatggaaaactctcagtgaatagtaaaagaagagtggaaactttgttcaagttgtgtagtataattccataagtgtaggaaagatatctgtggtgtattttgaaattgatgtagggctggtccatactagtcactgaatttgaaggtatgatcagagaagagaaatgggtaagaaagtgtgatgagagaccatgagtgctgagcacctggaatgaggaggagcttaccaaggtggcaacaagaaagcagctgtagttttgattatttacccattcataattatacctaagactagccttactacagactaaaggaaattcatggctggagtggaatgtttcaagagaccgtcctcaaataaggccattgaataaagattatatacttagaagcatgactgagcataaacgtgctagatacctagtatctgcaatataatagctggtcagtaaatttatgctgcgtatttgaaagttattgtgtcttggaattgactgcaatagtaaataagaccctgattcccttgggctgatcatatattggcctagataaaacagatggtctcgtcaagaaaaatgtgagatgctgtctaattttaaaaatttattttactttatagccacaaaaattcaaaatatttaaagtttagttacttatattttctcatttgaaacatataaaaactctgaaaagactcccttctggtttttctatctcttaatatttgtaagactgacctttcctactatagtataattaagagccaaattgcatgataatattcgtcttagtttatggatacagaaactaaagctcaaagagtttaaatcactttgttttttaaaggaaatatgtttggaaattaggtataaacatattttgaacagtggaggtaacagtatttttatatttattatttcccttaatggttgtaacaaggatacagaagagtgttcagtcacttgtagactgtagcctcttgtttgtcaaagagtgcttgttagtctttatctgactagacctctttccatatttgatactggtgacccctcctctcttccttggcttccactgtctactactgtgttctcttgattttccttctccttgctggatgtttctactcagtctctttcatgagctcctgtcccttttcctgtatcctaaatgatactcctcccctaaatattaaccttgattctctcctttctctccgctgtatcacacactcatcatgggagattgtttcgccacctagcatttcaatgttggtggcccccaaaacagtatcttgagcctgattcattcactaaatttatgcaagtgaattcagctatctataggatatcattccaatgaaacatagctacttaaaataccacaggttggaaattgaactcatcattttttcccactaaaccacaacctgtttccttcctggattttcccatatttgtgaatgatctagtaagtcataagtttagggccctttacagatttctgtctcttcctccatcccttgataaaatcaaactcgaaaccctgtatgctccacctcctaaccacctatttttgcactctcccttattattcttgacgctgcttctttagttttggtcaccatcagctctgtctagactactacaatccttgactaacttccttctctacctagtcttgggatttatttactatgctataaataggtttttgttgctgttttaataaagtgtatgcctgatcatgtcatgtctctgcttaaatcccttccatcacttgctactctttaactttaaataaatgcagacttgctgcctccaccttcttcctctttgccttgataactgttattaatcctttaggatatagttcgcttgttatctctcgcctgcctgcctcaagcttcacctcccaagtctgtgttagctgttttttcttggcattcccataacattcatctcatgactttataattacctatttgcttgtgtgtatcctctactaaactacaatttcttttaatacagaaacagtttttgtactctcagaattcagctaaacatgtacatatcaggtgcttcataaatactggttgagtaaatagttgaagggtaaccattattagtttcgttttaattaagtgaaaattggaacttaagaaaggtaattaactttccataggacacactgctactgagtgagagagctgcattaggacacattttattttgtaaatgttttattttatattttattttaaagccaatattcatctcatgacattttatcatatattattactaagctaagataattttaaagaataaaatacaaagactgtatacatattttattttatttttaattatactttaagttttagggtacatatgcacattgtgcaggttatttacatatgtatacatgtgccatgctggtgcactgcacccactaactcatcatctagcattaggtatatctcccaatgctatccctcccacctccccccacccaacaacagtccccagagtgtgatattccccttcctgtgtccatgtgatctcattgttcaattcccacctatgagtgagaatatgcggtgtttggttttttcttcttgagatagtttactgagaatgatgatttccaatttcatccatgtccctacaaaggacatgaactcatcattttttatggctgcatagtattccatggtgtatatgtgccacattttcttaatccagtctattactgttggacatttgggttggttccaagtctttgcaattgtgaataatgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgatggccagtgatgataagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagggtttttatggttttaggtctaacgtttaaagtctttaatccatgttgaattgatttttgtataagatgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcagatagtgtgatgcctccaggtttgttcttttggctgaggattgacttggcgatgcgggctcttttttggttccatatgaactttaaagtagttttttccaattctgtgaagaaagtcattggtagcttgatgtggatggcactgaatctataaattaccttgggcagtatggccattttcacgatattgattcttcctacccatgagcatggaatgttcttccatttgtttgtatcctcttttatttccttgagcactggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagaatacaatcatgtcgtctgcaaacaaggacaatttgacttcctcttttcctgattgaataccgtttatttccttctcctgcctaattgccctggccagaacttccaacactatgttgaataggagtggtgagagagggcatccctgccttctgcccgttttcaaagggaatgcttccagtttttgcccattcagtatgatattggctgtgggtttgtcatagatagctcttattattttgaaatatgtcccatcaataccgaatttattgagagtttttagcatgaagggttgttgaattttgtcaaaggctttttctgcatctattgagagaaccatgtggtttttgtctttggctcatttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctgtgcccggctttggtatcagaatgatgctggcctcataaaatgagttagggaggattccctccttttctgttgattggaatagtttcagaaggaatggtaccagctcctccttgtacctctggtagaattcggctgtgaatccatctggtcctggactctttttggttggtaagctattgattattgccagaatttcagatcctgttattggtctattcagagattcagcttcttcctggtttagtgttgggagagtgtatgtgtcaaggaatttatccatttcttctagattttctagtttatttgcgtagaggtgtttgtagtattctctggtggtagtttgtatttttgtgggatcggtggttatgtcccgtttatcattttttattgcgtctatttgattcttctctttttttctttattagtcttgctagcggtctatcagttttgttgatcctttcaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacttctttatttctgccttcatttcgttatgtacccattagtcattcaggagcaggttgttcagtttccatgtagttgagcggttttgagtgagattcttaatcctgagttctagtttgattgcactgtggtctgagagatagtttgttacagtctctgttcttttacatttgctgaggagtgctttacttccaagtacgtggtcaattttggaataggtgtggtgtggtgctcaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggactggctttatgaatctgggtactcctgtattgggtgcatatctatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatcattttattttgagcctagtctctgcacgtgagatgggtttcctgaatacagcacactgatgggtgttgactctttatccagtttgccagtctgtgtcttttaattggagcatttagtccatttacatttaaggttaatattgttatgtgtgaattcgatcctgtcattatgatgtcagctggttcttttgctggttagttgatgcagtttcttcctagtctcgatggtctttacattttggcatgattttgcagtggctggtactagttgttcctttccatgtttagtgcttccttcaggagctcttgtaaggcaggcctggtggtgacaaaatctctgagcatttgcttgtctgtaaagtattttatttctcccttcacttatgaagcttagtttggctggatatgaaattctgggttgaaaattcttttccttaagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagggtgttttccaggttggttccattctccccatcactttcaggtacaccaatcagacgtagatttggtcttttcacatagtcccatatttcttggaggctttgctcatttgtttttattcttttttctctaaacttcccttctcgcttcatttcattcatttcatcttccattgctgataccctttcttccagttgattgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactccgttcctttggaggaggagaggcactctggtttttagagtttccagtttttctgttctgttttttccccatctttgtggttttatctacttttggtctttgatgatggtgatgtacagatgggtttttggtgtggatgtcctttctgtttgttagttttccttctaacagacagggccctcagctgcaggtctgttggagtaccctactgtgtgaggtgtcagtgtgcccttgctggggggtgcctcccagttaggctgctcgggggtcagggacccacttgaggaggcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcgtccaggctgctttgtttacctaagcaagcctgggcaatggcgggcgcccctcccccagcctcgctgccgccttgcagtttgatctcagagtgctgtgctagcaatcagcgagactctgtgggcgtaggaccctctgagccaggtgcaggatataatctcgtggtgcgccatttttgaagccggtcggaaaagcgcagtattcgggtaggagtgacccgattttccaggtgcgtctgtcacccctttctttgactgggaaagggaactccctgaccccttgcgcttcccgagtgaggcaatgcctctccctgcttcggctcatgcacggtgcgcgcacccactgacctgtgcccactgtctggcactcccaagtgagatgaacccggtacctcagatggaaatgcagaaatcacccgtcttctgtgtcgctcacgctgggagctgtagaccggagctgttcctattcggccatcttggctcctctccctgtatacatattttaaatttactaatgtattgcccacagcctgattattattgtggtttccatggaaatcagtaattttggtgctatttctttggaggaagctttgaacatttttatttacattggataatccaaaaagtgcaatgggaagtgtgaagagactcaaaatacactggagtggaacaaaagtttgggatactaaacaagaagcaactctcattcccctttttgggagaccaatagtgaacaaagagatgtccaaaattactgacttaaaaaaatatgaagacataaaaaggtcattcgatgggtacacagcaatgctgtgcacaggtaaggcagagaatgagatggcacaaccataaacatacatggaagagggtagacagaatgtcctttattgtgtataagttgtcaatagaacaaatgtctagaatacaatgggaatctagaatgtaagttggatacatctgctatgctaggcaatgatgaatcctggaagaaatagcagggaggttaacagctgtagcagccaacaaaaatattgttttcaaaaaactaaaataaaagatattagtggcaaggagacaaatgaaaagacggtattttctgttagttgctgaaacacatttctgctgtacaggatccacatcaggatccatctagtgattaacacacacttttttaaggttcctgatcagggcattgagtggatttgtgcacatttgttggagaggtgagaacacatggtcaatttcaggtaatctggatgtattctgagatgattaagagtccaagggtggttatagccatttaaatcagacgtagggacaatttctttttatccaatatatttatgctaaagaatcatctggtttttcctgaagttcaaagttccacagctgtcctatattttattagctaaatctggcaagtatacagaggtgacctcaacggatcatattaatgccttggttttagcaaacaacactaagaggttcaatgcccaggaggagctgcaagagtggtatatattgagatgatgctgatcaacatttgactgggcattgaaaaagaaaaacttatttatgagtgctgccatccatggtagatggtggagaactgtgtgaatgccttgttcataatgataaaaggtcacattttgattggattttcaagaccaaccatcaaaagactattctcaaaaggctgagagccattaaaatgctaagttagtggaaggaagagagcagtggtttttgctttgtttgttagtgttaatacgctgtttgaagaagtgctcaacaataattcagtgcattatgggatatgaaaatttatttctctttattttatttcttacctaatgttctgggtagtctattgaaggctagtagggagaggtatatgtgttgaggggagttgtgcgtgttgggggcggttctcttagataatcatttagggactgagacagacagtggttctaccatctttaatgggtggcttgtaatgtcactctgtttttcttcattccagccagcaaaagcgcgtggaaaagcaaatgtgcacaattttatgggcaaaccataaaatttgtacatatcactttcattagaagagctcagtcatgtgaccataattagttgcaaagatggctgggaaatgtcattccagctacaatcctattgctctggagaaagcagaagtgaattttgatggtcagttattttttgccactgtgtttttcattgtacaatagagttgcattacaggacttttagatagaaggaaaggtagacaaggaaagcaagggactgttttaagtattagaagcaatttttcccatcattttgactcaaagaaaatatgaagtaaaatatgagataggtgagcaccctctgccatgctctgtatttgttcttcgtttctttgtttctcccacagagtgggaatgttatgatttgaatgtgattttagtattttaaggaacataacaatatgaccactggatataagtcaatcacttcatctgttatttaactgcaggtaccacaatctattttaacactgaagaaaaaggtgatatattggatttcatgagaaatgatatgttatgatgatatactttatggtgacaagttctttggggcacagttttgactctacatgaattatcctttactcacaaacttcagagcctaatatcaacgtaaaaaattctccttgcaaaacaaataaatatatgctatttcttcacagtccctagagtttagctgttgcatgttttaaatgtatttcaagtctcatgcatcacagacaccaagacagttgttcccaagtagtgaggtctataggtacacaagggcaagtaatttacatgttcattaaaggtaccacataaaagtaagaagaaaaatagtaagcagctttggagtgtgtatttgatcagatcaggtactatcttgggcaactttattaaaataatacaaattaatctttactaatcacggagaagttatttcgtaacagattgaaaatctgaattgaccatacacatgaaaagcctcattacagtttaaatatacaaagtacatgaccagtggcaatccttaaacaaattaagaggaagttatgtttgaatctcttgtatggcaagggagatattcttgcctgtatttaaataagtatttagcatagcattagtactgacaagcattcaaatgctaaataagaaggccgggcccagtggctcatgcctgtaatcccagcactttgggaggccatggtgggcagatcacgaggccaggagatcgagaccatcctggccaacatggtgaaaccccgtctctactaaaatacaaaaaattactcaggcgtggtggcatgcacctatagtcccagctgcttgggaggctgaggcaggagaactgcttgaacctgggaggtggaggttgcagtgagctgagattgtgccactgcactccagcctggtgacagagcaacactctgtctcaaaaaaaaaagaaaaaagaaaataacattatcttggtaacagaattcatcaaaaccaccccaagtcaagcaacatgctagtgacagccaaatatcacatttgcattactcaatttttggagctatgcctcagaaaacaattccttggaataaaagcttaggcttatagtttgtggcagtgttcagtcctgagtaacctaagtattgtagcactttctgactctaaccccaataaagaaaatttggtttcatccatattgctaggagaaacaaaaaaacagtaaaactatctctatgtaataaaaggttattttgaggataagacctttcctgagtatatgagtagatcatttctaacaaatagctgtgtttatataaagttttgcttattaatccttatatcaacaacctataccctgtgaagaataagtacagagacacacagcattggtaagttttgagagttatattttgctgcctctggaatatcactgagaaactctagatactataatttatttatctaaacagatacaggaacaatgtctttccttccctcctgaaattatatagaataagaggataaactatgtaagaacctaaaaacaaaactttaaacatgaaatatgaacaaataaaaatgactggcaacttcacatttttggagattctggctctaattggtgactcttttgatagtgtatatttccaacccatgaatcttacttcctgaggcacattttcaaccctaattctgactataggccaggtgtacttcggcactaacaggctctttaattcctcctggcccactcaattcttgttatttcttattgagttcctgtggctatttggattttgaattctgtttgtcttgttgtttctcttcttggctttggtgatcaaactaccacagtgaaattcttggctcttaaatacctagtgatattgacttgactgatcattaggctgtaccctctactcaagtaactctgggggagaattaataaaacgtaaaccctattttgcttcccaacttgccttttggtttcagtgacctggattataacatagctagagtgaagagcactcagtgccaagtttggcattattgcttgagctcatacattaccgaaatcacgtgggtgtggcttgatactattgatctttttgtgattttactgttcacaattactaaaaatagactgaattattgtaaccacaagtagaaataaaattctagcaaaacacaaaaatatgagcaatttctactgatggcattcataaaaataactatgaaatcataatgtgcttaagtgagaatctatttttctcttaattgagcatagttctgttatttcaaatatagaacattttcttctatttcacttttaatagaacacctcgtatttataactaaatcatctttaaattttacgtttaaagtcaaatatattagttatgttttgagtgttcttaagagtccttaaaaatagtttgtgaacacttctatttctgactgtgctggaaatgtgggaaaactagcatctgacaaataagccattggaacaaaatacagagatcataaatgaatctgcacatatatgatcatgaacacctgatttatgtcaaaggtgccactgcaatgttttggggaaatcatgtcttcaaaaatagtgctggatcaattggatatccatctggaaaatgtaaatcttgactcttgcatcacaaaatatacaaaatcaattgtagttggattgtagacaaattataaaagttaaaaaataaagcttttagaagacatcacagtggagtatcttaatgaccttggggtaggcagaaattacctgaacatgacacaatttatgtgaaaatatagcacaattcctgcaaatgagaaaaaatgctggcgggtgggggagattttccttagacaaaagttctgaattgatattcacaaaaaccagtatataaatgtgcaagtagtttgtgctgaatgttattaatcataaggaaaatgaaaataacttcactaccacgagaattgctaaaagggaaaaaaaagagaaaaaaatcagaaattaccaaggattggaggaatatacagagcaacatgaaatttcatacactgcatataagaaagtgaattcgtatagtctctctattaaactctttgccagtgtctattaaactagaatatatacataacttgctccagcaattggattaatagaatcaatggacatacataccatactgatttaaatgaaattaatcaatgagaaccaggacagtggttatattttgaaagttaatggctagacaggatcataaaggaggcttctggagttctggttccagttatatctctatccattgttggctacaaagatggttagctttggcaaattctttatccccttaagatcaatgcattttacagtatatatgctattcttgaaatgcaacatttaaaaaaatgttgagcaatttagtacatagaaacctatagtttaaatgctaaatattatctttatatgattctaaaaattaactaagtttcaaaaaacaattcatagatattactaaaagaacctctttcctgagctggaagcagggtaagaattatagtaaatcatgttttggtggccgtatacagacagactcttaaagtgtaacttttagctcttccactgcctagttgggtaaccttcagcaagttaattgtctgagtgtttaatgtatcattaaatagacgtattacttactttaaagtgactacatgatgaccaaaatagttaatacatagaaagtacttaaacaattcctctcacaaagtaaaaatttaatacgttaactgtattactttgatgatcattattttgttgtcactttaacaccactatattaggtctgtaaagtaacaatgaaaataatactattaatatgtgacgcagtcttagattaagtcattcattgaccctgttcgtcagttttgaagcctatagagtagtagtaacagcagtagtaatagtaataataataataatgacaacacctacccagtgatccacaacctagggagttggactcgaaattctacactgttagcccctctgctctatggctttacaaaaacacctatcagtcaggatgggctagggtgtgctacagtaacaagcaatctcaatgtctcagtgggatatagtgtaaagttttatgtctcactcatgctatgtacaatgggcagagcctttgtacagagggcagaacctctcaggcacctaggctgacagaagatccacatcttgtcatatgcttccataattatcaaggcaaggagaagaaaatgtgagaaattatgccccggtcctcaaaacttttgcataaaagtgttccaggttacccctgttctcacaattttggccaaagcaaatcatagggatgcacttaatctcttcagatggtaaggaaatataatctttccaggagataaggagccataatatttggtaaacagcactaaaaagctaccacaaatgctaagaatattattttcctcaaatgtgaaaatgaacataatagttataattaaaatgcaaagagctatgtaattataagagatattatttaacctaaatttatttttgtctctattgagcatacatgtgggatttcattttgggacaaacatcaattatattaacactttttttattactcatctcagtgttcgttaatttttttttttttgagactggaatctcactctgtctcccaggctggagtgcagtggcacaatcccagggctcactgcagccttcgcctccaagcgattcttctgcctcagcctcccaagtagctgggactacaggcgcccgccactacatcctgatgatttatgtattttttaatagagacggggtttcaccatgttggtcaggctggtgtcaaactcctgccctcatgtgatccacccgccttggcctcttaaagagctgggattacaggtgtgagccaatgcacccagccaagtgttcattagttccaagctttgtaacttgaataattaatatttacttcaaatgaaattaataacccccattgtgaattttttaattgcatgattgaatattatagattagatagttcttatattttctatttttacttaaacttggaaactttaccacctaataactacacctataaacagaataaatgtgtcaaaactttatataattaagactgattaaataaggttttttcagtatgtttatgtttaatcattaaattatttttattaaaaatgattaaatttttccaaagttcaatatctaatttggagtcacacatcactgaaaaagtgaatatagggagtcaaaatagatagtctgtacacatgccaatggacatgttacatggaagtcttttgatatggtaaacttatataataaaataaaagcaatgcacaagaccaatataacacaaataattagttgtagacaataagtggggaatattaaagatccactggtagtgtgcactgtctcctctgacctgcaagcaagatcacagatagtgtgtatttttgtatctacagctggaatgattgcagattaataaaattatgaaatcccatggttaccagaaaaaggcatgcttctcttggatgccttgttcatctttgagtgccaggggctctgcacaaggcaaagaacacaagtcctcaatagcagtattttgtgatacttaagtatattgaaaagctgaaaggtatagctatgctttagctcttccaataagaacccaagcagtctattaggaccaatatgtatgaaaaacaataacatttgggactttaagttggcaaaagttcacttcagtatttagtaataaaagggtttttttaactgtgacaatttaataaggctgcattactagaagtattaaaataattctaaacacattagaattattattatcccacccaataggcaaaaaaattttaaattttataacatcaagtgttagcaaggctgtggagtaacaagaactctgaaaacaatgctggtgggaattgtgcatatttgctcctgtctcccacactggccagaccacttctgggatggtaaatttaattccaagtaccttacaagagcggttttctttttattttctttattgtattaaagacttgaaaattccttttcaaaatcaaaattgataaggaggcttactatgtaaaatgaataaaagctcagcctgaaaattggaaaggctgggtgggtggaggtagaacccaaatccttcctttcttcgatgaggcttttgtgaaaaccaccaaactagagagtatcatcgggcctatgaagaggaaaccatatcagtaagagatggttgaaagaaatgaagatattcaacctgagaactgagagatgaacttgacgactgatctcagatatttatagaaagagctttgggctgggagaggacaatgtattctgtgctgctgctgagaacaaaactagaataaaggaaaggaagttatgagaaagaaggcatttcctctgacttgagaaaagtaagaaaatgatgaacactccacttacattgatttgatctttataaattatatgaatgtattaaactatatgcacccccaaaagatgtacattggtcatgtatcaatagaaaaaagaaaatttttctaaaacatgaaaaaataactacctaatgatgaacatagccaactaatgcaactatgaataattgaccctacagatacaaagcaaaagccaataccagcatcaactatgcctcaatctacctgattgccctttgtcagcttcattttttcttctaaatgcagtttttcttaaatgctgtttctcactgggcctactgctctttctattccattaatctttcacttcaggtaagcaagagggacaattctgacaagataagcaagggtcaagtgatatgaaactcttatccactaatattggcaatcaattgcaattattcttaggattattagtccctcaagcctctcttcattgatcagctctctattcattcgtctcacaccttctagctcaaatttgctgtggtatcataatgtgtttgaaagagtgcctcataagcaatgaaaaaaacagagtatctttaaatattagtcaacagctggtttaattaaatatctctccgcccacactgtactacattgattactttttaaagaaatggctaaatgaagacattaattatttgtatgtggtgcatatgctttcatgcacactattgtattttaatttactttttaacaagtaagccaatatgattttaaaattatttcccatttgtcatggatgctaataaagaaaagaaatctactaatttttgccatattaaatttaacctctttttttgtgctttctagttacatagttcttgaggaaatcaaactagaaaaaatggatttaacctttctgctttttagtccgcataaatagacacttagtgtgggagataagtgaaatactcacttttggctgccttaacagtttggaaatagaatatgtacacatttttctcttgattatttgtcttttattaatcattctatgtaaaactcaaatacaataaggcaaactgattactctgcaaaataattgtcatctgaagcattagataattcaattatattctgcttcttttgggtgggtatattatgattagttttttggcaattctataaaccacatagagtatgtatggtaattctgtattagcctgcttatttactcattatgataccaataccatgtgccataaaggattgcttatgcatatataagcacatggagacattaagctttctaggtgaaaaatccttttgagttaatttgttatggattttgaaatttcttaaaaatttaaactgtgtgtatatgtgtgtgttttgtacttatggacagttgtgcaaattgctcattaatgatattaacaagaaaattacatataaaactagatattaatgaatatactttatatatttttcaacgtaaggctgaaaaacatgcttctaaaaatgaaagttatactgctgcttttcagatggattatggattgtctggagatcatattcttattgtaatatttaaataaattctgatctaatttaaagggagtgggacagctacagggggaggagcagctacattcagtgtttgcgaagttccactctgtttctgtgattctgtcatgagggacaccagatctagaaagctcttttcttcctcaacacaatctttttatgctgtgcttccttcactttcaaagaacttgtacttgccatctctacagttctcttaaatggaaggaaatatttataaacattgagttatcctggttcgtgaacaccaccaccacatcctcaccactggatagaaaacagagtaacttctctgttatccctgaacaaaagcttagctcttgtacttccagaatcaaagacagttcatctcaccacatttaattctgtgaccctaatttaatattattttacctgggtactgctgatgctgaatttgatcgaaggactacaatcagaaatgcatttccttgcactgacctattgttatttcctctaaaatatatttagaagtgcagtaatcatttagataatggaaagaaaatgggattgaatgtcagaaaacatcctctgtctctgttgcttactgtctgtatgacttcaaacactttacttaaatctcctgtgtcattgttaaaatgcaagtgatagtagtccacctgagaggatggcatgggaaatattcaaatcaatgagtgtgaaaaagtgtttcgtaaatataccagaactatgtctgttcttataagtacgacaaaagtagttgttcgctttgaaatcagttactgaataaataatattgattggataaacatacagtctttgcaagtgtaccatacactttataagtgtatcatagacctagaaatcttagaaaataatatatatctaggtttttcccctgaaaataaaccaaaaaattttcaggtatttcaaaaatagatttgtatagatgttttaaaatcttttattcttttactattatctctttgtgtataaaagtcttataattacttctttttaaacctaaatttagcatatttcttttcattcctttaactcaattgaataataaattgttttttaaaaagctctttaaacgaatattctctaatgacttacccaagaaaatacctgttgtttttttttttcagaagtctgaaccactattttgttctttagtgaaccacgtaactaaccacacagctttaaaaatgttgctgtatcagtcaaccataggtcattcacttcattcattcttccattcatgggagtgctgctggaatgtatatggatgatggtaatgggttttccatgaaaactgtggtagattccatggtcacttattcaaggaatttatcccctttaattttataaagaacttatgggcttaccttagcctatattgcggaaaccaaacatcactaatgagcttagtaaacaactctgggttttcttactcatgagaatttaagtgattcacctgtgcttccttttagaaaacatgaaattgaaatctttgctttatttcaaagtgggtggtctgaggtactaaattgcattgctaatgcggaagtacctgagcctagaaaaataaagaggaagaatgaatgttcacatgctactcttacagtctgatggcattacattgacctgtctccctcacggtggccatgcttccgtggtccatctttgccacgatagcattttaactgtgcagtgtaattcacctgggattgttcttatcctatgtgagtgctttattaattagcttcattctttctcatattctcaatattaacaataaaattacctagatatttttattttttgacaaaaatatcactttcaataattcagtttttaaaagttatatcattcacaatagactagaacaacaattgttttctttttgggtcacccaggacttgcctctagatctgtgataagactagtctctgtgaaggtaccaaacccaaagtcctgaactggaattcaggagacttgaatttgggtcttgctctttcactaacttggtggaagatgtaatcctgtgcttcagttttatcagatgtatcacccagggcaagtcacttgacttcctttatgcctcaatttcctcatctgtaaaaggagataatagaaatgattacctcttagcattgttgtaaggcatcaatgagattatgatgataaaggacttagaactgtactgggctcatacgaagaacctgtgtgttatctacaataatactaatcttccttgtcatagctcctgtgcttttcacttcacaaggctatactgagaatcaaatgacataataagtattgtttcagtttttattgctgcatagcaaacttatcaacttaaaacaacatccatttactgtcttacagttgctatatgtcaaaagtccagggatggcttagttggatcctccgatcaggaattcaaaaggctgacatcaaaatatcagctgagttgtgttcctttctcctgctcagggtcttctttcaagctcatagggctgttggaaactcacacggatgtcatttgatcagcactcaggaggacctcatatattgtaaaacgctcgataatatataactaaataatgatgcagggaaagattgaaaacaattacatctttcattaaaatagaatttaacccagaaattcacacaagaaactaccagtactttgttaataggagtgccttcagggcagggctgaattccatatcgacacagagattagtaaaacttttatacatggaaataagtaatattatataaaataaggaatatagatttcagattatatttagtgggttttttgtttttgtttttgaaacagggtctcactctgttgcccaggctggagtgcatggtgcaatcatggctcactgaagcctcaacttcctgggctcaagtgattcttccacctcagtctctggagtaactgggactacagacatgtgccagtatgcccagctaattttttttgaattttaatagagatgagttctcgttttgttgcccagactcatcctgaacttctgagctcgggcaattcttttgcttcgtccttccaaagtgctgggattacaggcatgagccaccatgcccggcttgtatctgtattaaaacttgactctgccactcttggcaatatgatcttggatgaattactttttcttcctgggacttgatttctgactctttaatcagagtaacactgtctacttcaggagatgtactgaggattaagtgaaatatcctatgccaagctcttagaacaatattgggtacatagtgaacacttagtaagtgatgactattgttgctattgctacgattatttattttaataatcttaacatgtagcttcatgtctggaacattatgtgctcagaaaatattactttcacccttcttcagtatctgtttagttgaactggatctgtagaggagaatattttggatattatcaatctgaactaggctaagtggttgccatttgcctaattttatttaattttctacgattttcttcctcccttccttcctgcttgtttgcctgcctgtctcccttcctttcttctttctttcattgtccttcctaccttctttattcttctctgtctcttccttttatttctcaaccttttttttcccaagcagatattattttaaatttccgaacaacttatgtcagcaagtctggccaagttatctttgaagcaagatcaatttgcatccactatgtcacaacctggttcatcattgatttaatcgctgccctgccttttgatcttctgtatgctttcaacgtcacagtggtgagtaaagagctccccgccacatggcctttaaggttgatttatttatcgcatgttcaggttttaaatgcttgtggcgatttatgcttccagggttttgtgccttcttcaataaagatgccctgatgcccagtgatatgcaggccagattcttcagttgatgaagttacttccttttgacattcatattagctgttcatgcttttttcaatacctggagccaggaaacacagaaatgctgaatttatcataaatactgacccactaaacaaattctttaataaggaaatcatctgtaggaatttaagcatcactttatattacctaggcagatacatgtgtcaagaatttgctagagagtttgaagatttttttttctgcttgtatgacccttaactctctatttctttagtattttgttattcattggcaaaaccaactgaagactgatcaagatagagaggactattgaatttaaatgagaaaattcaaccgcttcttagaagtccttgtaaaactgttggatgtagcaaaaatctaaatcatatgactaatgtaaaacttgagagttctcttgaatttgcatgaatcttggtaccttctttttcttgctctaaatcccttaccctcatgtagcctcccaggacagaaagcatatcacttgtagtagcagccatttttataatttaatgattggtattcttaaaagtattaaatgctcccttataaagaaacttttagggaggccatttgtgaagcagtaatgcaattttctgctagagtaaccaattacggcgtgtaaaactttattaaacattagttcaaattaatcagatattctagtcaattgacagtgctttatagaaatcatattctctttcaaaaatttaaaggcatagttttaaatattaaacacaataatcacagtttcaaatacaattatcattaacttcagaatgaatatggaattgtgatcctgacttgttagtgcagacttgtgcatttgttaattgcctgtacaatagtttctttttattctttttctttttaagttgggaggttgacagtgccaacatctttaaaacgtttatgactcaactgaaaggaaagctcccaggaaaaatctagtacatatcaatcactgctacattgaattgttatctaggctttctacagtgctttttaagattgaatttgactagataagtgtaccatcatgaaactataatggcttaaaaccatgtttttgcaagactgcagaataagtatataattcacaaaaggttaaaaaaatttccaaattcccctggcaaattgttttaaattgttcattaattatttaatacaattccattttaaattaatttgctgctttgctactaaaagcgaatacttttttatgttccatttttatttgagtactgagcgaatattttaaatatgtatatataatatacaattatattataggtatatataacatacatttttatatcattaacattctcattccccagaattaacatggatgaagaaatgccttaaagtctaattcgcatgtttgatgaattttaaatatttatatactttcactacactcctgctctcttttcgtcaatcttatgtaatctaacacaaatgcttcataaataatacaaggtatagggcaacatctgtgtcaaaaaaaaaaaaaaaagaaaagaaaaaggggaaggaatctgttaccagtgatacttgttctgcttttcacaggagtgagcatatgagaatttaaaaagctggcacctaaattcgttatccctcttaaacaagttagtcaggatcaaatatcctataatatttgaacagaaaagcttgttcaaggtattatgttttcttctcaggaaaacataagttatgaggaataacttatgagttatgctcttttacaacaaagacttagaaaaagaaacaaataaccaaagatgtttgtctcccaaatctaaaatatgtccagttaatgcatctccataggtgacattcagaactgcataagctttggctttggctctgctcacaattgctcatggcagttcttttaagtacggatcacatgctttttgaaaactagtatgtatatcactgtagaaggcacttataagagatacaattatgaataagacataggaatgttgatagagtagaaagggcagaagtatgaatccaagttctatcatttaccatctgagtaacttatttggggaagttaacattaaaatatccataaaatgggcataatataattcctacagagtttttgaccagactgaaaatgcaacatatctatacaatgctttgctaaatgtctaaaacctaagaagacctcacaacatattagttagccacctctctctctctttctcccttctgggtaatagctaggagatgaccatgtccattggtaaaaggggaaactcccattttataggggggtttgatgaatgcacctgtctatgagtagcttataattctcatcagtgacagatttgaaacagcatccaaagagtcaaaagaatcctgtccctttttcagatacatatttccatctaagtcaaatatgcttctttctcctgtcattcttcaagagaaaacattaaaactgtagcaagaagctactgactccgatgggagcaaacataatttctttaatgccagtttttattgacttaagaatgaacaaagaactatgtgggtcatctggacacctaggttcaagttcctaatatttgcagatgactattgttctcatgtacaagcagctctacattctttgctcaaacatcccctttccggtcagagaaaatggggagactgtatcaaaattatgtgtgcagatgccctcctccatttgggacttccgttccagttttcatttcacttacaaaattgtcacctaaccatcaaattcatctacctgtaaaataaactccatccccagtaatatctttaaataacagaatagagattacaaatcttggcatctgaccatctagctaaccaccagcttgagaaatcatagatgagaacttagctataaaggagaagaaagtaaaacttgacacaggagaatgacaaaaagaaataaaagagcacagctagctgtcaagttcttcaagcgcccttaagagtttactgtatttgatatagaataattcacaagattacaactgaatataattttgttggatatcaatttctacgctgagcttggagtgtttgcatcttaacttgataatttattcattcactcatctaataaatatttattgagcattttctatgtgtcaggtactgttctaggtatgtttttcttagagataagagaatatggctagcagaggaaagaattggaagtcaactgactttagataaatacaaaagcaaactcccagtgctgaccttgtgtctgttcagttttgtaaaggaaagagtgaggttagttaaagccataaagttactccttctctacttgtgctttccccaaagaaattaaaggtgacatcaagaagtttgtcaaactgcatttccatatgatttaatgttttatttgttgtttctatcttagaatgttctttgaaggtatgaaaagaaggtgtgttatgtgcaccccttattaatggtgatattgactattctggtccacaccaatgatacatatttttcaattggaccctgaagtcaataaaataacccctcagctacaagtctactgctatagtggatgcaaaggcactaggagactcttcagaaattcctgtccatttcattttaattccctaagcatgtctgagagagcgctgagagagagaaagagagagagagagagagagcgagcttcaggcaaatgtttcctctgtccattgataacgttggaagtatagtacatgaggcagaagatgctactggtacttgtgggcagaacttactcaagttttatgggtctacctattttaaaaaataatctctaaggtatttttattatcactttctgtgcctttacttcaatttgtctgaattattattataaagcaatttcattacacagggaagggaatgtagggttgaaagaaaatatgtgtaggggatttgagatatgtacaattctgataccataatgtgtttcagttgtgtatcagaatgtaaactgcagtatgaaatcagacaggaagtgaaaaaaagataacccctaattaagaaaggtgtttactcaaataaattaaattatccttcctatcctatcctttattccagcctctttaattctatcactttctgatataatatgtcaagaacaaagaattcataaaaataataatatgaaaataattatacttcatttccagaatttttagaatggctccaagttaatgttgtggtatgaatttaacacatgcaccaagttgtgctgctctgtctcttaccacaggtgtctctcgtgcatcttctaaagacagtgcgcctcttgcgtcttttgcgtctgctgcagaagttagaccgctattcccaacacagtactatcgtcctgactctgctcatgtccatgtttgcactccttgcacactggatggcgtgtatctggtacgtcattggaaaaatggagagggaagacaacagccttctgaagtgggaagttggtaagggcttacatttgtcacattttccattttttaatttaaaaaaaaagagtatcaagaacttggaggaagtgaaagataagtctataaatatatttattcttactatcaatttgtctaattaatttctatttttgaatccatgacacaagtaatttatttcaataaggttttctggaacaacgttacatttttttcaaaaattaatgggttaaactgagaaattttatatataatcaaaatgaccagtttggctgtagaagtgtttagataaataatgttcaatcttatcttgaaatgttccgatgcagggctagtaatagtaaatcactgggaaactggcctatggtctatcactacgataacttaactaataagaaaatgatcacttatatttgaggtggcgtattaatagagaagatatcctaccatccttccctttacaaggagagagagagtgtgtgagagcgaaagtaaacaaaataacacattctccacatttagcacactttgagaatttgtgatggtagaacggactggacatttacaaacataatttatagttttgagtccccataatacataggagtttaagggagattttttgaatgttacataatctgcataaatgaatcggaaacactatgcacatgaacacatttttaaacttatgtcaaccacagtaaatttatagaaaatgaaaattctcaaaactataactctctatcccaaaaatctgcatttttctcacagtcataccctttagagaattgtcacagtaccttatgtagaatttttttttattaatctgagatttaatcaaaagaatctgcttctcagttggctagaaaatccttcacttatcttctctatcaaaaatcaatcttgaacttttggaagaagctcagacctttgcataggagactgccaagaaagaaaaatgcccagacttttcataccagcacttaatggctggacatatttggaacatccctgtgttggccctcataaatggcaatctctcagcataggacatatacaaagccttcaaaggcagcactggaggaagagctggagaccttaggaaagcaggtggaagggaataagctcctctccaagttcttaaaaatacctcttcacatcccaattttatttctgagctacacaaaacaactgatgtgttcttataatttttatcttagaatgtttttcttatcttctttatcaaagcactttttaaatgtcttgctgtgggtcctcaattctaggaaacaaagaaaatggggaaataaaactaccaagtgaaagcaaacatatcttagataaaaataagatccaataagaaagagaaggagaaagagagagagaagagttggttaaaaggaggatcagggtctgaattgtatgtggattaaaacattttctatctttcgatattgttttcttctccataactttgtcttgaaggcttcctcatcacatcatatgtcatcatcctaatggtgttcagtaaattacagcattagatctctgccctttgttttgaattcatattaaaattctgacttgtggtcagcacctgattcctttttagacctgacctaattttcctcaggccccagacctatacactcatattaatttgtaagtctcgtctggtctgagagtctccagatggggaaatttagcttattcacactctcaaatttagttatatgaacaaagccttttgtttcatttccaacatgccaggcttgctgcagacttaaaatctagctgttgtttttcttcccacaacatatagaggtatttatttgtcaattaaaaaaaaacaatctgaattgcttctatatttacccccttacttgtattcttggtccttgtattatggttcaatgtaatgagtagcaggttgtaagccagaaaccaatctcgcagagagagcattgtcatgaagtagtggcaagaagagcactgggctgggggcaatagacctctcctgtcatcatggttccattgctaatcagctgtcagatttgcaatattttttttcacctgtttgggcctcagtgtcctcgtctacaatgtgaaaaagctcaccatataatttgaaagtctatttctggtttcatgagtaatgattatcaagaataaacaaaccccaaaatgtgcttcatatatctatatatacacacacacatatatatacgtgtgtatatatacacacatatatatatatgtgtgtatatatacatatatatatttttcttattatgggtcagtgtccacataaaccatcagaggatatattagaaagtacatcctatgatcatggcatgtcaaataattgataatcttactcatttatgataaaaatgaccgaaaatttatctttagagaattagatttcctgtccaagcacctactgggatatgactagcaagagagtatgctaattaagtgtgtaaatattgggtttacaggcttgtctacaaagactttcccttctcctaaaattacttgcatcatttaaatgttcatttaaaacattccccagctgagatttgaacacagattaaataatcatgaccttccctacctaactttataatgaagtagcttagagtctacgctactttaatttttaccctgtaatctgtgcactaatggtaaattttacctttttgggtccaattatcatgaatccaaaaatttatcatacaaatatttgatgagagagcatgttgttccttatgtttgtgtttaacattagatgtataaaaatagattcagtttcccaaaggataaaatttctttctaattattgttaattccataaaatgagatatttaagtgcccattacatacttggttctgtgttaggcactggggataccaaaacaaataatagagcttaaaatctggtgggaaaagtagacaaagatttaatgggcatattacagtgcaatatattttataaaaggaataggtatagaggggtggcactaaatctaactagaatatcatcaaaggcttctcagagatgacctgagttttaaagggtgaataggccttgtctgtatagatgctgaggaaaaggcatttgtgacagcagggttattaatatattaagcaattcactctcacagaaggtgaatggaggtgtggtagaaaggcaatgaggccaaagaggtaggtaggtagataccagatctttaaagactgtgctaagctttagagtgtagacttcatcataagatacagtgagggataaagttcccttttgaacagtgatcctttgaacatagagcgccaccaaacagtgggagatgtttcactctgcttcattttcaaggactgtaaactgacaataataatagtgccaacctcagtggggttaccagtattaaattaggcaacatatataaagcatttatattggtatgtagtaactgctcagtaagtaacagctagtataattctcattatcattgtattatgacaattacttctaatgaaggaaagaccatgaactatgactagtgaatacttatcattttatgtacgaaagttactaagaaatagctttaaaagtattgcctttgcggtttagtttggtgctggacaaaaattatatgcttttgcatatcttcaaagtaatttatctgtaccacctttcaattggaaagtcagcctctgaaaaatgtttacataggctcacaattgcacatacgtaggaaatttttatttcaggttcatttaggaggcaagtcctatatcaaccttgtaaccttgttaggatatatcaaatttttatggaatttagatatagtgcttcaagggtaagattaaacactgtattaaagagacatgtcacaactgaatcagagagtgctttttacagtttaatttttgggaggctgcaaagaaatgtttcagaaggatctctttgcagggagtggaggatgctttatttgtttacaagaggacgtcaataaatatctaaaaatgtacaagtagaccttgcatgttttcttatatctcagttaatatatgtatatattattttagctactatcacttctaaggtttaatcaatgatattgaattagtctctgaagaactccattagcatcctaatgtgagttctgatttgcagctcaaaagcttcaggtctgaatcctgcttcaggaatgtgattttgaatcaggcatgtgattttgaccaaaatgacctcaatgtgtggtttttcattaaacaatctcagatttgttgtctatgagtgtggcaatactgactctcatgagtactcacttcacatagtatctggtacatagtgtgtgcttgcagttggtaactgccagcattatcaccaccacctctgctcttattgttaattgaagccctctgaaactccagccacctgttcaaacttatatcgatgagcaatgtagaactgaaatagcaatactcttaaagtctagtgaagaggtgatatttttgtatcagtcatgattcttgattgcaagtaaaaacaaaaaaggaattcattagcaggatgtgtagactcagaattagaaggatacaaaacaagactaggaaaagaacatgagctaaggtagccccagattgccaatgcaagaagttcaattgtgacatttcacaaggatggcctgaacatgtttctgtctgtagatcctgtgcgggagtcctaacttcccctgcacctctgattcacagtgcctgagggaagaattcaattggccaagctaaaatcacatgctcagacacagactgccaggacaagaagactctttccatcttacccttccatgatggaaagtggagccctgtgtctctccattactatatacaatgaagaacccacccatacccctaccagatacgatgttagccagcaaaaaaaaaaaaaaaaaaaaaaaagcatcataatgtcagacagaattagctgaaatatggagaagtggtatttttgatgcatcttgctcactgtaacaaatctgtgttccttatgtgagtctaacggtggaatcctacttaccaatctgtgtttcctcagctataatagattgtgtcttggtcagtagctcccattttatagctaaaatgttaccttatgttctttttcaaaattacctctaagacaatgacaatctgaattttaaaataaataatctacttcaaaggtcaaagagtattttgtaatagagaggaagctcttttatctcttaccctttggctggagcaagcgtatccattgcagatgcctaaaagtgtatctgtatcatgcggggtagggtgggaaggccaagaatctagaatgggaaaaaagggattaagtcagacatcattttcaaattttcattgacaattttaatcctaaatctcctgatcctcgttggataaaacctcataaatgctgattgatttgaacggctctctagttattaactacttagcatttacaagccttttgtaagaaaaaaaaatgaccaggcttatgatgttgtaggctgattacttcagtaactgcatcggttttcctaaagaaggttgaatttactaaccctactttttcagggtttacataaagaattataaaaacttttaaagctaacccttacttgtagattcgcattcttaagaatgcatgagataaagaaaagaggaaaaaatctaaaatgaagttttccagccattaaagtggacactagtgaaggactcctggatttatttttttaaaacataaaccagtaccttaagccttaatgtgcactggaatgaaccaaggatctcctttaatataaattctaattcaggaagtctgaggtggagtcaagaccctccttttttaaacaaactccacagtgatgctggtgtcactggtcctgcacaccggactgtgggtggcaaggtttttaaaatgtcttgagacttttgaggaagttaatactcccagttgtaaacaacactaaccagtaacaattcagtcctttctatccttttccaccgtcctatactttttcaatccccaacacatctgcaaatttatttggacatagtttatttctgatggacaaaggaggtctatctaaaagcagttaacctcaatactgaagtagtacaacacagtacttaaaatgtcatcacaaacaatttatattactgttagttccagaagacgcaaatcaaataccatccattttaaaagttttgtcaatgctctattctattttcataagggcttctagaaaacagaaaatatttccacgttttagaagtaagattttactcttttgtcgtaaggagcaaatggtatattttaaagactcaatttttttatattttaagtatagcaataaactttgcttcttataaaaatagaggaagtaaagtatatatagcaatgtccaattatgaagttgcattatctctgcagtctgatctcgtatttaaagattattggggcatttagatagtaagaaatacaaaaatttgcatttaattgcataatattctcagtcctttgaaagggaatttctgggtttcaggtagcagacagggagttaatatgatttcaagttgccacggttgcttaagaggagaaaatacttatacctagaaaggaatgaacctacaatatactcagtatctttgcaccacagtttccaaatgtgttcacacttcctaccaaacactccaagcaacaaagattctgttatcatgtaagtttgagaaatgtagcacactgcatccctgttcgtaaagactgagaaggtatattagcagcatataataagctcagagaaattctgaagaaattgattaaactttatttaaaagaaatgttgcataaatttattttctatcataatctttttcttttttgtacatattgttaatactctattaacatcctatcctatgaatttgaagttttaaaaacacaccttaggaaaagttactaaaaccaatatcataataggaagaataatcatggttttaatcttttaaaaatataggacatcacatgtatcatcctacagtaaatctacaaaaatagagagcaagattattctcgctacaaaatggagataaaaatgcctacttagaaaatcactggtgagcgtaaataagagtatatgtgaaagcagtttgcaaattgaaaagtgctatagaattatgatgtgttatttttgggtcatagttaacagtatacacacatatacatacatgtgtatatgtatatttatgcatgtataagaaagaaagacaggaatgtgtatatgctataccacaaattcctgtcttcgtgttctccacgatactgatcctagcatggatgtagagaggacatgcacaatacatgtatttgagtgaatggatgcaggaataagtgggtgaacaacaaatagggattctgtaccttattactaggtcaccctttagcttaaacgagaaagacattctgaaatcagtcttccttcagtgtttggaagttatgcttgttccgtacttccttatagtatctcatcatttatactgtacgattataggccacattctcgttagtcatttggttaaaactgatttgcctaaaatatagacaataaagttataggaaaccaaaagtcaggattctatttctattcaatagtctattcttttggatattttggctacccaaatactgaagtcccttagtattcagattacacttgaggagaaactgttttggttttctctcaaaagatcttataatacctgacaattattaatataagttttattaagcatttataaatatcacaaattaatccacttggggtttggttttctgatttataaaacagtatccaagtgtaccttgcccctacattgtccttgctcttttttgaaaatctttgaccttttatacgataattaacttgcaatctgtactctacatagtcctcacatctactgacaatctcatacaaacaattactcactttcttctgttcccccccatgaaatacatatgtaaagaatatatatatatatatatatatatatatatatatatataaaatccttctgtttatggtattactaaagaacaatctttaactattacccccatcatggaagaacatattgcaaactctaaatatttataattttattgtgaaaaataattactagattaataagtctatgggtactgactacccatacaggtataaggtataaggtataccttatacaggtataagaattaaatactgactaagtctgagtcactgatttgaaatgtaaagtgtgaaatttcaatgtgcttatagaaaagcgcaggttttgaaccactcacactgatatatttttaaccaaaacagacaaattagctttgatgatgaaaataaaaatcataaccacagtgtcatcatattcctaaggataaaaaagtgttaagcagctaatactttgtgactgaggttaattgtcattctgtagtgatgatgctaatcactatgcaattttcattatctggactttgttaaagcacctagtatatattttattgaaacctgtgtagtatgttttacattatgccccatatgacattttaatatgtagattttagaggccctattcctcatcagatgtcctgaaatttgtgtgaggaggcagtgcatcagtcaattgtaaatgtattttcaatttcttactatgtgatagcatcagtaaaggaaatgataagcaatgatttcagttttatagaactttaatttcaccaagttacaagagaaaactaatcatttcacctgctcttcactctctatcctgttgctttttctgtatttcctgtctcagtaaatggctcaagcatgcttccatcttctagctggagataaatttagattggcactgcttacagctcttgttggatacagaatccctccaaagagctgttgctttctagtctcatcttcctagtctcattttggtttctcagctttcaaggaatactcttggctcttaaacatcttaggctgtgccttggacctagattttagaagagtgggtcttttttgagtattttctccaaggagtctttgttttaaggtgatagtttgctgaccattcattggttccactgcttctctgaaaggatctatgacttcaatcactgtttttctattctactggattttcctgagttgtgtagttgttaagatcatggacaagtaatatgcttctggctctgggagtgtcatggacttctatatttaaatgagttcagtgttgaagacatgtctcacacaagaactactgatcttagggtggcctaaaaggtaatatgaacattcaaagaataaaatgaaaagagatttatttttgataatgggagcaatgtgatctactgacttgaggtttggatctatcctaattaattaattaattttctaaacacctactcagtttcctagtatcatttatcaaataatcgatttatttccactaattaaatatagcattttaatcatgcttaattatgcatacttatggctcttactaggcttcatttttcttctgttgacagtataattttacaaaaatattacatagttttgattattgtactttaaaatttggggtatagcaggtagaatagaggacattttagctcatttacttatttagataaatattaggaaaaacatccctgccccaaaaaatctaactggcattttaattggagttaattttagaaattaaattagggaaaggaatgctttgagaacattgagactttttgtccagttcatggcatttaatctccatttatttaaaatattattctgtataattaagtgaaattgtgtaattttctttacacaggttgcacgtatttcttaagtatatttttaagtattatgcatttttgtgcttctgtgaatgggatctatttttcattgatttttgtttcagtcactactgtataagaaaatctagtgactttaaattattttatagaaatatcaaataatatgtatctaataatgtttgataagttttatattttctgagttttttagaaagacaatcatataatatatacatactaataaatttctccctgacttctaatatccatagtctttttagctactagcttgagaaaatgatgtattttattaaatatgtgctgtaacttcactaacagattttgctgaaaagatgttttataaatcactgacaggcattatcatcgacgcttgatatacattgatgcttgataaagttctgtgatataccacagaactttatattgtggttctcaaaagtgtatttcataaaagaacatgacataatagaacaattcttaacctggaggttgggaatactttatcctaatcaagccctgccattaattagccgtttgacctaggacattttatcaaaccatatttgtctcaattatttctctcaaaatgagataattgactgattcttactgagtttcaatccttcttgcatcataaaccctttgggaaaatgaatggaagctgtagatatccaatgataaattaatatgtcatatataaatgatatttgcattaaagtatagttttatgtttcattagattatttcataggatcctggtaaacaaaacacacaaaaacatctgagagctagttgatctctaaaatttttaacttaaggaatatttggttacattacctttaagaaatgtgtcttgcatatgaattttaggtctgttgaacaactaatgccttggtctgttgacatatctttagtggtaaatgaaaactacataacagctgccataactcactagtaaaacattttagtctttatattctttcaggttttataccattaaagtataattgtattctgtatagtaatatgcttctgtgaaatccctctcatttaatccatttcttcctaaagttcttaaccttcggagacttttagctatagccatgaactttcaattttgctattgaaacaagcttaataaaaattttcactttacatgcaacttttcagaaatgtagtagtttcttaaattgagagaaaccaaccactctccaggttggatataaaaataacctgttttaaaatgttcaaaatttcatttctggtttaatttctaaaggacagtaagaagcaagggagattcctagtattttaagacttctgtcatttgggcaatgttctaattagcccagatgttgtgagattcttcacaacatagtctttaattgctgtatttttttcaacccccatgctcaataaccttatgcaactgagttggctccaggtgagttactcttttatttaagccactgtagcccatagatgcacaggatgttagcataagaaaggactttagagataatatattctaaatccctaattttacttgattgtttcctttgataaggcctcataatgtagtggggagaacatagattgagtgttataaaattaagagtctatcctggccctacacctcagatttcttctctgtaaaatgagctagtcagatcaaatgatctccaaaatctttaaaacatcaacttctcttatttgtatgagaagaagaggggaacaacagctcttttagtagaattattctactccagaatatttctgaagatcgaaatatatttttctacttccaaacatccatgaaataaatggcttttatgacttctgacccttgttccaaagaaggagtaagtctgacctgatatatgtctttttaaaaattactttgtagtctatatgcttctattctgaagcccaaacatagtattttttaatttacagcattggaaattaaagataatatttacaacaagtaatagaaaataaggtgtgatattaatggaaatataatctaagtgtagtttttttcttaagttcatatcttccctatctttctatgcctgtttctgctaaatttacaaatgttgtattcagacaagaatttatctgctagagggatttggagcccccaattgcctggttcagcaacctgagctgccccaccctgcctagacatagattgtagtacagagggaatccctctgctccacacctacgcagatctccagtaagttggaacatctgttcacttgggtcagcagcctgagttgccccacccctcctgtgaagagatcttgaggtgatcctttcttctccatggtcaggcagatatccaggtatttggagtgcccacttgtctgattcaacagcccgacctgccccaccattcctagacatagatagtggtgcagtgagaccctctctgcttcatgtccaggcagatcctgaggcattcagagcacctgtttccctggttcagcagcctgagtcataccacccctccatgcagaaatcttggtgcaggggtgctgtctctgccccatgcctaggaagatctccaggtatctagagcacccactctcctagattgagcttcagctgcccctattaccatgcagagatcttgaagccaaggtttctcagctccacatgtaggcacacttctgggtacatggtgaccacccactggattctcctttggcactggtgcttgtgcctgccatcagggaacctgctggcagacttgcttggtccagccctacccttcatggctcccaccccttggagagtgagcagagagttcagaccactgtgcattccatgagtcagtgcattggttgaggcaacagggagcttctgccagtaaacaaggatcaagtatatacccagccccattggtcacaaccaaatcttacctataagtgtcatctatgggcttgtaggacaaactgcacagcccaatttaaaacctgctaaaagaagtacgtagacatagaatttatacaagcaaagccaaaagaccctcctcatcattctctatagccacagcccctagggtggaaggggaaggtaaagggaaagaaaataataataataacattatagggaaagaaagaaaaagaaaaaatcctacctgcatgaacataattataagaattagaagtgccagcatctccagatgagaaggaaccaaaacaagaatgctggcatcatgaaaaatctgaatgtagtgacaccaccaaaggactgcactagctcccctgcaatggtcactatccaaaatagaaactcagaaataacagataaagaatccaaagtatggattgcaaggaagttcactgagagacccaagaaagggtggaaaatcaacacaaaaaaaattctaaagcaatccagtaaatgaaggaagagataaatgccctaaaaagaaaatcagtcagaacttctggaattgaaaaactcacttaaggaacctcaaaatacagttgaagatcttatcaatagactggatgaagtagaagaaagaagctcagagccagaaagccagtcttttcaactaacccagtctgacaaaaatgaagaaaaaaagaattttaaaaaatgatcaaaatctttgagaaatatgagcttatgtaaactgatcaaacctacaaattactggcattccttggagagaaggaggaaaagcgaataacctggaaaatatatttgaggtaatcattcaagaaaatgtccctaatcttactagagaggtagaaattcagatataagaaattcagagaacacctgtgaaacactgtacaaaacaaatatcaccaagacatataaccactagactatccaaggtcagcactatagaaaaaaacttaaaggcagctagaggaaaaggaaaaattacatacaaagggaaccccatcaagctaacagcagacttgtcagaaaaaggcttacaagccaagagagattgggagcctatctttaacagttaaagaaaagaaattccaatcaagagttttatatcctgccaagctgaactcataaatgaaggagaaataaaatattttacagacaagcaagcactaagggaatttgttaccactacacctgccttacaagagattcttaagggagttctacacatggaaacaaaagaatgataactgccgctacaaaaacacactgaagtatacagctcacagaccccataaagcaaaaatacaatagaaattacacagcgaacagctaacaacttcatgataagatcaaaacctctcatatcaatattaacctggaaggtaaatggtctaaatgatccacttaaaagtcacagagtagtaagttagataagaaaacaagacccattcatctgctctcttttagggatctgtttcacacgtactgacacccataggcttacagggttggagaaagatataccatgcaaacagaaaacaaaaaacaaagagtcggagttactattctcatatcagatgaaacagactttaaagcaacaacagtaaaaaatgacaagaagcacattacaacattacataatgataaattgttcaagcaacaagaagacttgactatcataagtatgtacacaccaaacacaggagcacccaaattcataaaatgagaacttctagaactacaaaaagacttagacagccacacaataatagtgggggtattcaagaccccacgaacagcattagacagttcatcacggcagaaaaccaaccaagaaattctggacttaaactcagcacttgaccgactggacctaataaacatctatagaatactccacccatcaactatagaatatatgctcttctcatctggacatctggacatggaacatactccaagaaatcatgtgctcaataaattaaaaaatacttgaataagtctcaataaatttttttaaaaaactaaaaatcatacaaactatagtctcagaccacagtggaatacaatagaaatcaatacaaggaggcctctcaaaaaccacacaattatagggaaattaaacaacttgctcctgaatgacttttgggtgaacaaagaatcaaggcagaaatttcaaaattatttgaaataaatgaaaacagaaacataacataccaaaatatctgggatgtagccaaagcagtgttaagaggaaagttcatagcactaaacgcctacctcaaaaagttaaaaatatctcattttaacaatctaacctaacatctagaggaactagagaaacaagagcaaagtaaccttaaagctagcaggagaaaataaataacaaaaatcggagtggaactgaataaaattaaaacctaataatccatttaaaaaatcaaccaaaccaaaatttagtttcttaagaaataaacaaggtcaatagaccacaagattatcaaagaaaaaaagagagaaaatccaaataagtacaataagaaacagcaaacaaaagattctcagagagtgttatgaacacctctgtggacacaaactaaaaatctagaggaaatgaataaattcttggaaagataaaatttcctaagattgaatcaggaagaaaatgaacactgaacgcaccaatattgagttccaaaattgaatcagtaataaaaagcctaccaagcaaaaaaaaaaaaaaaagccctggaccagatgagtttaccactgaataataccagaagtacagagaaagccaggtaccaattccactagaactaatttcaaaaaattgaggcgaagggattctccctcactcattctatgaatctagcacaccctaataccaaaacctggtaacaatataatgaaaaaaatcaaactacaggccaatatccctgatgaacatagaaacaacaattctcaacaaaatatagcaaaccaaacgcaacagcacatcaaaaagttaattcaccatgatcaagtaggcttcattcctgggatgcaaggttcgttccgcatgcacaaaacaataaatgtggtttacagcatagacagaattaaaagcagaaaccatatgatcatctcaatagacacagaaaaagattttgataaagtcaaacatccttttgttacaaaaactctgaagaaactaggcatcaaaagaacacatcttgaaacagtaagagccatctatgacatacccccagccaatatcatacttaacaggcataaactgaaaactttccccttgagaattagaaaaagacaaggatagctattctcccaccttctattcagcatagcactggaagtcctagagagcaatcagtcgagagaaagaaataagagtcatccaaacaggaaaagaagaagtcaaactctcttttggggagatatgattctacaccttgaaaaccctaaagactctgccaaaagactcctgaaactgataaacaacttcagcaaatttcaggatagaaaatcaatgtacaaaaatcagtagtgtgcctacacaccagtaatattcaagctgaaagccaaatcaagaacacaatcccattaaccgtagccacacacacacagacacacacacacacacacacagactacgaatacatcaaaccaaggagatgaaagatatctgcaaggagaattacaaaacactatgaaatgaaaccatagatgacacacacaaatggaaagacattctatgctcatggattagaagaatcaataccattaaaatgttcatactgcccaacacaatctacagactcagcactatttatattaaactaccaacatcttctttaagaattatttaaaaaaaatagaattagaaaaaaaattctaaaatgtatatggaaccaaaaaagagtacaaacagctgaaacaatcttaagcaaaaagaacaaagctgaaggcatcacattacctgacttcaaagcatactataaggctaccatagccaaaacatcatgatactgatataaaaacagacacataaaccaatgggaaagagtagagaacccagaaataaagccatacacctacagccatctaatctttgatgaagtcagcagaaataagcaatgggggaaaagactccctattcagtaaaatggtgctgggatgcctagatagccatatgcagaagaatgaaactggacctactacttttcaccatatacaaaaactcaaggtggattaaagagttaaatgtaagacctcaaactataataattctagaagaaaacctagaacacaccattctggacatgggccttgggaaagaatttataactaaatagtcaaaagcaatcacaacaaaaacaaaaattgacaagtgggaccctataaagggcttctgcacagcaaaagaaactaccaacagaataaaaagacaacctaccgaatgggagaaaatattggcaaactatgcatccaacaaagtctaatgtcgaagatatgtaagaaagttaaacaattcaacaagcaaaagacaatttaaaaaaaatgagcaaaagacatgaataggcacttgtgaagagaagacatacacatggccaacaaacataaaaaatgctcaatatcactaatcataagagaaatgcaagttaaaaccgtgagatgtcatctcacaccagtcagaatggctattattataatataaaaaataataggtgttggtgaggctgtggagaaaaaggaacacgttggtggcaatgtaaactagcttagccactgtggaaagcagtttggaaatttctcaaagaatttaaaacagaactaccatttgacccagcaatctcattactggatatatatccaaaagaaaacaaatcatttctatccgaaatacatatgcactcgcatgttcattgcagcactattcaaatgcaatagcaaagacatagattcaatatgggtgcctatcagcggtggattggataaagaaaatgtagtaaataagcaccatggaatatcacatagccaaaaagaaaaaaaaaaaaaagaatgaaatcatgccccttgtagcaacatggatggagctgcaggccattattctaattaaattagtgcagggacagaaaaccaaatactacatgttctcataagtaggagctagacatcaggtgctcatggacataaatatggaaacagcagcaactggggactactagagaagggagggaaggagggagaagggcaagagttgaaaaactaactgttgggtactatgctcactacgtgggtgatgggattattcatacctcaaacctcggagtcatgggtaacattttttaacccatgtaacaaacctgtacatgtacctcctgaatctaaaataaaagttgaaaaagaaaacaagagattagaacagagacaatatacatggctagaagaccttgtgaagacacaacgagaaaatagccattgacaagccaaggagagaggctttagaggaaaccaatcctgctgacactttgatctcggacttccagcctctagcacttgggggaaataatttgttttttgagccagtcagtctgtggtatttgttacagaagccctagaaaactaataaaatgccctcctctgttttaaaaacaaaagagttcatctgaaaaacaactcttgttgcagcctttcacattttccctttaaaattaatatgaaggccaggatgaagacataatatgacattttaatcatcagtaaaagttaagtgtcaaccattgatatgttgtaagaaagcagaggaattttcactaaaagccaagtaaataggattggattttaaaaatataaacagcagatagcttgagttttttaagatacttattctaatgggaaatccttcaccccatactcacactctgccctctgattcagagagctgaggtctccaagaaaatgggacaatcgtccctctacagcttagacattgctttaaaacgtaacagtcactctgctaggcccagtagctttgttgttcgattcaaaagtaaaagaaacattaaagtttacaaaatttctcaactagagtttggagcagggaaaggagatactcaaatgttaaagtgtcaatatttactgataagtaggaaaatatagttataatgggattttgaaaaattaaaagtcaccactaaataaaatttaaaatagaaaacatacaaatcaaacaaatcatgaaacatatggaaaaacattgaaaaaaaggaaatatcaagaaaatacaaatgtaagaaatagtaggtcataaacaccatgattttaaaaaatgtttaaagcataggaaacagctcaggttatttcatgtgaagaactcaggaaacagatttttacatattacatgattcttatttgggataaaaaaggaaatacacacacaaaaggattgaaaataaacccaatgagtagtaaaattatttggaagtttttctttttaatcattacaaaataattgatttatatcaaattaatattatgcttacacttattgatcacaaactattgcatggaagagtgcttaatacattcttgtacattttttcatctgatctttattgcagtccatgaggcagataatttcaagcccattttataagaaagaaactaaaacttgaaaagcttgagatttcctggagatgctttaaaattagcaaatatcttaacttgaaaaagtttatgattaatataatagaaacctgccagaaattattgtcttaacattttgccataattgcttaatttctatttttaaatttaataaaatgttacagataaagcccttcagttctcacttgctccctctttctctcctctactattataaacttggtgcataagatttttagatactatttttactacacaaatgtgttagtaaaccaatatttggcattattttgtctcattaacttctatgtgaataatcacaaatgaaagaaatgatggtaataataataatagcagacatacatgaagcttcctcagtgccaagcagtgttctaggtacctacatgggttaactcatttaatattgtcacaattctatgagcccaatactattattattcccatttacaggtaagaaaacacaccatagactaaataacttgtcctaaatcacaatcacacagatagtatacatgagagctgggatttctgtcttccttttgggatttttactttctcaatgagcttttttttttttttttttaagatttatccatggtaatagatataaatcttacatatttatttatgtttattattctacaatcagctgttgatttattcatttgggttgatttatctgtctccttactgaggcacaattacttgttttgtacttattaataaaagtagagagcaatgagcaatcaattatgagttcccttgtatatatgcacgaattcctccaggtaagatatgtacaagtgtacttgctcagtccaaatgctcgtgcatctgcaaagttaacatattaggttggtgcaaaagtaattttgccatttctttaatgcaatgtaaaaacaacaattacttttgcaccaaactaatatattgctaaattcttgtctgaagtagttgtgccaatttattgtttggtagttttatatattctttccccagatcttcattagcaattgttaccagtgtttttcaatttgtaaaaatctgggtggtatgaaatagtgcttaattcttattttaatttccatttccctgaataggtaaggtggaatattttttcatatattttttgaccagtactgtttctctttgatgaattagacacttagctcattaacttgcaggttatcttctttcctacgtaatctatttaaagctatatattttaagtgtaaaaatttttaaattatcatctaaattatgtgggacttttgaagttgattcttattactgatttctaattatgtgcattggtcaccacagaatttggtttacatgatactgatttttcagtatttattgaggctcagtttgtacatattctttgtgtacttggacagactatgcattaattcttagtgttttatatatttccattagatcaagcttttgaatttaattatacacatattataagaccttattattttctaatcaaataaataaagaaattttatttggtgctttttcagatttcgattcactttctacagtgttcagtttgtgttttatagttcaaatatttttattaggtcaagcttctgaattgaagttaaatatttaaaacatactaccttcctgtattccccatttttgtttcattagttcaaattcattgtgttctaagtttctgttctgctaaccttgtgaatgataaattattccctcatgtgttttgtaatttttaaaaaattcttattctgagctcatcttcaatagcgctctttctgtagaaatcctgtgcacactgagctgtgaaaatatacagaattttggtggtgattgtttatgtctttgcttctctcaatgacaccaatattatcacctgccctgggatcaaatttttaaaaacttcttagcatcaaaattcctgtgcctcatagatagtgtgcttgcaatgcacatggctgaatttttaaatttgcttaaaagagactactttttaaagcttaagtttctttgttattcccataagctggtaggtaaattacttctgtctttctccctgcatgtttcaccctttcactaacccagttttataaaaggtgtagttccagtgtttgtaggatttaagagttatagcctgtgccttgcaaccgcatgaaactcaggcccactgacatcattaccactgattagcttcccacctcttcccctgtcagcaccaccaccatagtgtcagctaactaacttcctactctttatttttaatatggaaatttcacttccaaatattatatatatttggaagatatatatataatctaatatatattaaattagatattttggaagaatatatatatattcatatatgtatatgtgtgtgtatatatatatatatttccagtatttataggtatttatatcagaagggcttgcacattaactaagtttatgatcttgccagaaccacagtattaatttctgctgaaataatagagcctaaattccagtgcgattttgttatatattttgtttgaaatataataatggtagttatctacccataaaaggccaactgaataaggtttaattactctggaccttattcttgctcggaataagtaagattattacaagattattatacttataagtaatcttataagtaagatttcccacataaagatttccctttatgtgggaaaatcatttaaatgtaagacctcaaatcttcaatccttcaaacagaatttttcggttaccaggaatataaattatgcttctgaattgagaagagatcataaaatatgcttaatatacaattatttttttctaactgctactttaatcatagtaattcctttggaatgcatgacaagttaatatactgcagattatgtgtctaagagactatagatatgaagaaagacaaaacagaaaaagaaccaaggctctgagactgttgcagttaaatcctataaggttttcagtatttactataaaataaatcattaatgattacctaagagagacatactgttgtgaataatactaagaactgacaaataaagcctgcctcctttaaatgtattctcattagaaaatcaaggtggacacaaaaatattgtaaaaagtaaaataaaatgtaaaaagacaaaaatgttagtttgatgtatgtttgcacaagtagaaatttccttaaaagttcagaaagacacagaaataactctgaatctctctgaaggtggcatttgaactgggcttcaaaaggtgagtattatttgggggattcatcagagaacatttcaggtgagaggctcagtgtgaataaatgcataaaagaaggaaatctcacagtgtatttgaggaattgtgagtggatcagttggcttatagcagaaatttaatgaatagctgaatttgcaagataaataaacctaaaggagaaagagacatggtgtacatggatgaagcaggtcagatattaaactaaaggttaatgaaattaagttctgaaaaaggtggagaatgcaagtctcatctgaaagaactaatcatgacctaactccagcaccaatatagcttaagtttggccacatctgagttttctagagaatttgagaatcaggattttttgataaatctctaatatttaaacattggcaaatacttcagaacttgaaaacatcgtataaagcccaaacaaaatatctgtggatctgatcaagcccattagtcactaatttgccatcctggacacaaagtaagtgaaaaaaatggataataccaaaatgatgggttggccttttagctgaggtgtctgagtatgacccctaagacataccaagacagagaacaagagaagatgtaactaggtttcttgattgatataataatttagaaagtttaatgcaaacttgagagaaacactgaaagtgattttcttcacaatctttgtcaaacagttttcatccagctgcacattcttatgaaaacaaataccaatgctgtttttaggtaaaggtctcatgctctttatacttgcactaatgaaaaggtattctctgttatactaatggtgggaatatttccataacagggttttggcatttataaagaatttccaccggaatacattccccatatgagatgttaacaaacatggacataactcatagatacatgataggaaatgaaagataaacattttatctaaactagttacacatctggaataaaattttaatacctcttctctcctttctcatcatgcatgtgtatgtggctgtttgctttgtatttaggatttttccatctagtcacaaaaagaagtaattaaaatggttttggttttttttttttttttttttttgagacggagtctcgctctgtcgcccaggctggagtgcagtggcgcgatctcggctcactgcaagctctgcctcccgggttcacgccattctcctgcctcagcctcccgagtagctgggactacaggcgcccgccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccgcgcccggccaattaaaatgttttatgtggccttcagccctaaagaagttactgccaaaatgtctatgctgacatggcctttacttgaatgtgagagtctttggattttttgttattttttcattgagattagtcaggaaagatagaaacaaaacccaattttaatttctcagaaactcagagcccagaaacttattcaagatagaaaatatttacgaaggcccccattttaaaaaatggtggattcacatcctactatatttatccatactcctatcctttacaccaaactcaagcagaaatgggataccagaaggttcagtcaattgaagtactaaaggcaaaaataaaaattaactcctatttagctttctgtagctttcaacatctctaaattcattttctattataatgatacttaaaatttgcctttggcttgacagctctcaatgaacctgtgtttagtctcataggataaaatgtcatatgacaatttttaagaatgtgtgttctaagttcagacttcaaagcctagaccctgtacttactatcattgaaaatttatgagatacttaaattttacaggctgtctaaagtaccgcctgtaaaatagcaacagcattagctacattacatggttgttatgaggattaagtgatgtagagtgattaaatgctcaatatatgttcattgctacggctgccactgctgctgtggttgttttaactatcattgctattcttaacatgatgacattttatttaaatgactatggtagcttattttgttcccgataaactttatgtaacttttttgctatattgaagccagtgactgaactgcttgcagtctctaccaaaaacctgctgctgatggtcagggattaaaggcttatttttagcaatctttctagcctgaaatggaattctgtcaaggttggcttttttgactgtgacgcacagagggagggcggtatttctaattttatcatctgcccataaaatcatgttttagtgctagctaatttcattaatttttaaaatatgctggcttaggtttacaggttgaaaagctattttgtgactgaaatggtatattttggaatatgtcgtgactctgtgacccactcaggagtaatccataaaaatgatttcaaagagttgattagtgtctgatttacaagtgacagcacatgattatagcacattctagtctccaatgcagtgctttatatgtttcatacaaaaatgggcatagtaatacaaatatatcctccaaaatccaaaaaataataccatgatacatcaggattcagagagttagagatacttaaatgaaaatctggtattattttattggcaactgaggatatgtgactgtgatttctccatcaacaacatgcttagtgaatggtataagcaagccatcttatggtagtcattctttacaaatatgactatgttgactgtgtgtgtgtgtgtacacatgcatacgtgtgttaagagagaaggagggagaaaagaaagaagaaagaactgcaattcattgtcactgccaagttatagaattggtagaatttgacactttttaaaaaattggtgaaacaactactttttaaaaaattggtgaaacaactactttttattctttagaaaggacatattacatctttgggtaacaagataaataggaatattttaataaaatgctctatttcatgtaagtcagtaattactttcagaggtataaactggataatttaaaaaaatctttgtttgaccaaatactcagtatgttttacaaagtataagatattttgatctaccattttgaacctcccattttaagatgtttttgtcttcactgtcttgatccctaaggacatttctattgtgtgtttcttaatacagtcattctcattagaatgatagcaacctgtatgactgttaggtaaagggtactttctacaatttcattaaactaatttaattttttaatcaaattcttatacaacagagttaaacaattcctttacatttcctttttgattttattgaaattattttttattaagttcttttggtataaactttactaccaaagatttaattcactaatcagtttttaaaagttcatatcagatacactgagcttttttttagtaacatttctacaatgcccaatttttgtcaatttaagttttagtgagctcatttccatcaagaaaatgttattctttcatcaattttgagtcagttacaaattttaatctgtgcatttttagccattgttaattttattttttattatttctactaagtctaattttttaaaaatcaatgtttgctgtctttaatgttcctaaagaatgtataatctcaatcaggtctttttgttttgttttgtttggaggactaatcaattttaccatgctctgttttaaacatattcaactgtatttgcctctttgctgccacttgtgtttactaattggatataataattaaaatatgtgtttatttggtcaagatgcaaagaacatgagatagtacaaatgatggtaactaggtggagatggaggtcaaatggcattgcaatcaaaacggttgggtcaaaatatcctccttcagatattagacacctcagtggaacaaataagaaagtatatggttttgctatatgatactgatgtcttgcaaatagtcattatatcttagtttctatctacatgtacagatcatggtattttaacatttgaatttcccaactggcacatgtttatttgtagataaatacatattttataatgaaaattgtcaactaatcttccaaatcagaaagctaatttatatttaaataatacagttttttgtgacaaagtaatagaagactgcagaaaaggtgaaaaaagaactgtcattttaagcaggaacaatacaccaggcactgtgccagatgttttacaaaattattttcttaaatgccctcagcaaacaagaagggatttttagttccatattttagctgaaaaagctgaaacttagagagttagcttacctacagataaattattaagtagtggtgggggctgcagttcaaaccattctgcaaacccaaatcctgttttatatgcaaagcatgggtagctattctgtggtatttacaatttagaaagacattttttatcatttaacaaatattaattgagtgcatattaggtgcctcatcctgagctaggcttgggaatcaagtatataagaaagaccataatccctatgttcacaaagcagtcggcctagtattacctataggcagataaccagaaattaaagtgtgttgagacctccagtggggtgggaagtctaaggaagatagggccaagagattgatcagtttaagtaattgaaatgaaaaacggataacctagtttactgaaaagtgaaaggggataaaaatactctaaatgaaatcactgcaggtgaaagaattttgcaatattctgaaagatccttaacaatatttataattgttacatcatagtgatgatgatccacaatgattagaaattattatctcaacaccagcataaggattgaatgccagcaacctgaaatcttgagtataatcttttctaaagactgaaaagcttctctcatgattgtacatttgttgggtcagactgcatgaccctaagataaatcctaaaataaattccaagaggtttctactgcagtttctcaaagcctcggtatcttttgccttattatttctcttaaaattatttctttttatttatatttttattgtatttcaatagtttctgggggaaagttgaattttggttgcatgaataagttctttagtagtgatttctgagatttgggggcatctgtcaccaagaagtgtacagcatacctattgtgtagtcttttatccctcaccctccttccacccttccccctgagtccattatatcattcttatgcctttgcatcctcatagctcagctctcacttataagtgagaacatacagtatttcattttccattcctgagttacttcatttagagtagtggtctccaattccatccaggttgctgcaaatgccattatttcattgctttgtgtggttaagtaatattccattgtgtgtgtgtgtgtgtgtgtcacattttctgtatccacgcattggttaatgggcatttaggctggtttcatatttttcaattgcgaattgtgctgctgtaaacatttgtgtgcaagtgtctttttcgtataatgacttcttttcctctgagtagatacgcagtagtgggattcctggatcaaatggtagttctacttttagttctttaaggaatctccatactgttttccatagtggttttactagtttacattcccaccagcagtgtaaaagtagtcccttttcatgacatttgtgccagcatctattaatttttgattttttaattatggccatttttgcaggagtaaggtggtatctcattataaaatcaatattaggaaaatgaccatattgccaaaggcagtctacagattcagtgcagttcccatcaacataccatcattattcttcaaagaactagaaaaaacaattctaaaattcatatggaaccaaaaagtttccatagccaacacaagactgagcaaaaagaacaaatctgaaggtatcacattacctgatatactacaaggctatacaacaggctatagataccaaaacagcatggtactggtataaaaataggcacacagaccatggaacagaattgagatcccagaaataaacccaaatacttacaaccaactgatcttcaacaaagcaaacaaaaatacaaagtggggaaagaacaacctattcaacaaatggtgctgggataattggcaagccacatgtggaagaaggaaactggatcctcatctctcaccttatacaaaaatcaactcaagatggatcaaagacttaaatctaagacctgaaaccataaaaattctataatataacatcagaaaaactcgtctagacattggcttaggcaaagagttcatgaccaagaactcaaaagcaaacacaacaaaacaaaaaataaatagattagacctcattaaactaaaaaggaggaaatgatcagaagagtaaaccgatgacccacagagtgagagaaaacattctctaactatgcatctgacaaaggactaatattcagaatctacaaggaactcaggcaaatcagcaagaaaaaataatcctataaaaaagtgggcaaaggacatgaatagaccgttctcaaaagaagatatacaaatggccaacaaacatataaaaaagtctcttaaaattatttctaaaattttaaatgtgcattaatttttgcattatgagtatttcaaaataaagttgaacgaactccctgattctaggaagaattatacaaaacccatccccacgtcatttgtggtttccctgttacacacacacacacagaggaagagaatgagttagccattatattaaatatcagtccaaacccagcttttcttttgtttctgattttgataccttgaaagaaaaggaaaacatttaaagtttgaaaacttgtaagttaaatatacttcacatgacttcccgttctgtacccttaacttgagccaattcacatgaatttttctccataaatgccttatatttacctggcctagtaattattattcatgtgctttgaactgtcctaaatgtactttttctccatctctgttcatccaactctactcatcctgtacagtacagtttgaatattttcctccttctttaaactctttctggttgctccaactaggaggacttagtatcaccttatttacacttgtattagagtttccccaatagactgcaagataataaagacctttctcccttatttttatatttcacacaacaacctgaacattgtgcatgttcactaaatattttttaattgagagaatttttaattagctaattaagggctagagactgtcggagagatggactcaatgaaggtaatgttttagtcccctggttcaaggaaagtctccccttcagtagtagtggaaggaaatgcaaagggaactggtctgaaggtaaacttgactgggaacaggatgtgagaacagaacatttaggaatcaaatcttgtcatgaaggggcaattgctggcaaaaacaaaacgaacgaagaaaaaacattaactgtattcagttcagttctagtacaaaatatcgaagatagactttgacaatctgcagaatgttcagaaaaggaaaagcaggcacaggaagtggtgtcatatgaccttgaaaaagactaccacatagagggaagaggttggagctgaggtgttgacaattgtatttttaaacattgaaaattgctgtaatattacttaagagaatagaaatagggccagagagtggagaagcaacagaggcagatttggactcaacactagactttaaatgtgtcagggctgtgacaacgcagagaatcatgtgttcctggattcttagctcttgtggaaactggagccaaactctgccttccaccaaggcctgggatagccagagccctggctttttagcatctccctgagaatccctgatgctactcccttggtcctgctgggctatgctcctgctgtgctctggtgttcttggacttcccttttcccattgttgctatgcctcttgccacttctggtacctggccaaaggtggagagctctgtccctgaaggacacctgtaaaacttgccacatggaaattaaaacatgcttctcaaaattggagtttcttgaaaataccacccaatgacatataatgaagacatttttccaaattagtaggtcaagacttaggcaagtgtgtaaattaaatttctgttggcttgtatggttttgatatccccaaaccactcagatagatatgcatattggggcccctgatgtgctctgcactagaaataactttctgataatcagaattgtcctaaaattgatgtggcatacaagatatgaagtaaattttgttttgccatagatggccaggggctaggtgtcatttgactgaatgttgtgagtttaaatattagagtggatagccgctgagtttgctgttagcctcatgaccaagtgatatgatacggtcttaaacaataggagaggttgaacacccaaaactgtgactttgcttcttagcaatcagccactttagtcctgttcttctttccacttttgcctacttttgaatcaaaaatatcattgttctttatcctttggcatttgtccctttcattctatacgtttgctctttagtcaataaatatttccttcttcatgcaatgtgtatctttctcctttctcaaacctcctttcctttcccttttgtgttgagttggtgattcagatttatccatggttttgattaataaaatgtctcatctcatataatatcataagtgtcacagggcaaagcaccaaagggtaccaatggacatggccaggaacagaaacataaaaattaatgcaaaaggggtaagcagcctctatcttcaaaagaagatggggagttagatctagatatcgactagtcatatccttcaatgtttaaaggatattggcccattgttctgacagtgcttttaaaaaaaccactgtcaattctagttaggtttatctatttaaaactagatactgtagtttggttataatgtgaattaaaccagcttttgtgtgccatgctggaggctaaaccactttttgtccttctttccactgtttcaaatccattgaaaaggcattatagttgccaaataatggatttctaaacagatagttggtgtctgtaagtgaaattagaagtcaaatgccaatgaatggtatggttaaaatgtgatttgaagttcttagtttattcaatattttttataagttccaagaaattacatagaaaaatgggttcttataaacaaaagctatgaggttataaatttcttcacagcataggtatgacctatatcaatatcttgcaaagttcacaagacagtaaccaaagagttctattcctagaaaatgagtcattgggatgttgctgagagttcagtctgtggttccaaaaaggtcttatgttaccaaaatctttgcatacacagaacattaaaacccctcccaccaactgcctttggagtaatagctagggtttctgggagaagggctggggaagtgttcagaaaagttttcatgatcaatataaaaataatgcaaggtctgcagaccacacgtcctagatgatggagacagtaagtagacagtagacaacctgagaaattcctatttgcaggtggaaggagagagcacttacagagaaaaatctactggggtagctatttctatgaaagagatgaagtcagtcagaagttcattaatatcaaaaccttgactaacaagaaggatcaggagatagaagcatattaaaaagtgtaatgactttcaattcagacaaacccagattcaaaacctggtccttctccctaacagatgtccaccctttgttgttttgctttaaccttcttaagtaccaatattttaatatcaacatttcagattgtaatacatagtaggattaaattagatagtatataaagtacttagcacatcagaccatggtctcctagacaaacacagaaaaaagatcattacaacatactatttttatcatagggaatcaagtaacaacaaaacaaatcaatgccagaaaatattctgagtctgtgtcttaaccatttaatgacttcggtacctcataatggaaagtgtcatttgtaaataagaatgttgcaagatctttgatttctgagaatgatgcaattgtgtacattattttctacttacggaactgggatgctgaattaatatataggttttcaataatgaaggatttttgaagtctgcataattttcagtaaaacagaaatcccatatttaaaaaaacagcaccagcaatagtaaaagccttatattgaatgcttgctacatgtaatactgcattctgctaagcgctttacgtgaatcatgtcacttaacctcacaacagcctatgaagtgagttactattgtgttctccattttagtgagaagaagactgacagaaaaagaataagtaaacttacattacataaccactaagaggcagaactaagacataaaaaagtgaggcaacataattccaagacaagatcgcgtatgcacttttatatgctgcattgcttgccttctgggttatcaaggtttactccatcaccggcatctgacacatttctctctactcatgtttctcttctgcatttcgctgtgtttcttgttctcctgtgtgttgtctctctgcattctatctacttcttatttttcaaaatgactgtgcccccctttaggtctctctcagacaacgtcattgccctgtgtttacttcaaggccaatcgcttcaccagacgctggctgaaaacttattttggaatgttcaggcaaactcccactacttattgtttttcacacctatcaagccatgaaacaaagttacttatatgtttttaaatgcatatgagtcagaatccactcttttttttttttttttttttttttttggagacaagagtcctcgctctgtcaccaagcctggagtgcagtggcgcgatctcggctcactgcaagctccgccttccgggttcacggcattctcctgcctcagcctccggagtagctgggactacaggtgcccgccactacatccggctaatttttttgtatttttagtagagacagggtttcaccatgttagccatgatggtctccatctcctgacctcgtgatccgcccgcctcggcctcccaaagtgctgggattacaggcgtgagccaccgcgcccggccggaatccactcttctaacaaaggctgacacctcaaaattggtgtttccttttgagacttggacatttcctagaaacatgaagaaaactcctttagaacagtttcttttttttaacttttaagtttggaggtacaaacccaggtttgttacataggtaaacttgtttcatgcgagtttttgtacagattatttcatcacccaggtattaagcctagtacccattagttgatttttctgatcctctccctcctcctaccctctgccctctgaaaggccccagtgtgtggtgttctcctgtgtccatgtgttctcatcatttagctcccagttgtgagaacatgcagcatttggttttcttttcctgcgttagtttgctaaagataatagcctccagctccatccgtgttcccacaagacttgatcttgtttttttatggctgcatagtatttaatggtgtatatctactacattttcgttatccagtctgtcattaatggacatttaggttgattccatgtctttgctcttgtgaatagtgctgcaatgaatgtatgcatgcatgtgtctttataatagaattacttatattcctctgggtatatacccagtaatgggattgttgggtccaatggtatttctgtctttaatccatcttgagttcactttgtatatggtgtaaggaagcggtaccatttcaatcttgtgtatatggctagtctgttatcccagcaccatttattaaataaggaatcctttccccattgcttgtttttgtcttgtttgtcaaagattagatagttgtaggtgtgtggtcttatttctggattccctattctgttccatttgtctgtgtgcctattcttgtactagtgccgtgctcttttggttactgtagcctggtagtataagttgggtagcatgatgcctccagctttgtttttttttgtttttgtttttatttgttttgcttaggattgtcttggctattcaggcccttttttggttccatatgaatttaaaaatagttttcttctagttttgtgaagaatgccaatggtagtttaataggaatagcattgaatctataaattgttttgggcaatatggccattttaataatattaattccttctatgcatgagcatagaatgttttccatttgtttccgtcatctctgattttcttgagcagtgttttgtagttctcttaatagaactctttcatctctctagttagctgtattcctaggtattttattgctttttttggcaactgtgaatgggagtttgcttgcgatttgactctctgcttgaccattgttgatatatagaaatgctagggacttttgcacattgattttgtatcctgaggctttgctgaagttgtgtatcagcttaagaagcttttggcctgagacaatggggttttctagatatagaatcatatcatctgcaaacacagacagtttgacttcctctctttctatttgaatacgcttcatttctttctcttgcctgattgccctggccagaacttccaataatatgttgaataggagtggtgagagagggcatccttgtcttttgcagttttcaaggggaatggttccagcttttgcccattcagcctgatgttggctgtgggtttttcacatatggctcttattattttgaggtatgttccttcaatacttagtttattcagagtttttaacatgaaaggatgatgatatttatcaaaagacttctctgcatctattgagataatcgtctggtttttgtctttagttctgtttacgtgatgcatcacatttattgatttgtgtatgttgaaccaaccttgcatttctggcgtgaagcctacttgattgtgatggataagctttttgatgtgctgctggatgcagtctgctagtattttgttgagagtttttgcatcgatgttcatcaaggatattgacttgaagtttcctctttgttttacctctgccaggttttggaatcaggataatgctggcctccttaggaagtagtcccttcttccctcctttttggttttttggaatagttcagtagtaatggtaccagctcttctttgtacatctggtagacttcagccagaaatctgtgtggtcatgggtttgtttgtttgttttgttttgttttttgtttggcaggctatttattgctgcctcaatttcaaagccagttattcacctgttcagggattcaatttctttctggctcaaccttgggaaggtgtatgtacccaggaatttatccatttcttctagatattctagtttatgtgcacagaggtgtttataacattctctcatggttctttgttttttcgtggggtcagtggtaatatcacccttataatttctgattatgtttatttgaatcttctctcttttcttctttattaatctagctagtggtctattttattaattttttcaaaaaaccagctctgggatttgttgatcttttgaagggtttttcgtgtctctactccttcagttcgcctctgatttttgttattttttaactgctagttttgggatttgtttgctcttggtagaacagtttcaatacaaagctaaggtaaacaaaacccagtgaactctttaacaggttatttgtatacaatattcaagcatattatatggtctaatttattttacatgtacttttatgattcagatgttagaaaatgcatccccctccaatatttttggaaaaaaacgtgattagaattttcttttgaagttttgcaaaccagggaaacttgagattccttttcaatagatgacaacaccctatccttttaagttaaatggctgccaggaaactaccaaaaacagttgagaaatgatgtgcaaatttgagacgagacctgtcacttcatttttcctctctagcttttcaccagcctgaaactttgagaaaaaagagaggacaataaggaaatttggggcagattattaatgtgaactttagcatatcaataataaaataatttgcctggacttaattatttttatcccaaattgtcttcctaaaacatgtttttgtcctgatgtaatgcaagtgatgagtactttcagttaaaaaattcttatttagtaaacagtttcatttgtaaatgatactctgagctcagacacaaatgtatgtcccacaaacctatttaagccacgagaaacactagagcaactacccatgaaataaatgcccatgttggggaacagatctgaaagcattgtgaattgtaagtattttatgtaggaaagttaaatgcaacagttcatagttttatgttctgccaacttaaccatgagcctaatctttgttatgcttttttctattattagctgagatttaagaggcatttggaagtgccccagttagctggaaacagatggcctgttctttctcttcttagaatcaaccagagagctctacagtagctgctcaactgtggcttcagattgtttagggtttttttgtttgcttgtcttttgttttttttggggggtttttttgtacacatgatgatgccctattttggcaatttacgatactgtacaatctttcaattcatcattgcttaagtgaaatgctatactttagtaatcaatgttcaaaaacttcctatcgtacaaacttttcaacttttatgtagactattatgaactggcaacctctggactagtttaatacaagtggcacatttttgtgacagtactaacagtatataatattgcttgccctggaaggttgtatagcaatggaaatagagcacaagtgatacatacatgagaatgtgaaaatctgccatctttatcccatcaatatttgctgatggatcttccctcaaagaattaaaacaaatgaaagataaattcaaaaagtcatactttttacacagagttttgcttttaaaaaatgtcaatcatttgtgaagaagcattacagaatattatttcacaaaatcttagatgtgaaagcgaacctagagattattcaatccaatcacttcatatttaagtttaaaaaactgaattctatgaaggatcacagagctactcaattagtagcaagaccaagcataggaccccaatttcctgactcaaagtccagtctttactattttatgattaattacttttgtttcaggtgtttatctcaaaagtagattgtactaattcagaaatgtaagacacttcttattttgtgagaatcagactgacattagtgggaattccaagtcgtaactgctttcctgtcaaactgggacctaaatttactgatgccttctgagtaaatcaacaaataacactaaatgccgttacggctttgtgccattctagccttatccttgatcacatctcataaaatggaaaaggggtgaagggttgagagtgagctttgggaactaagtctctaacctctttggctctatttcttaaattaaaatgtgaaaaatttatagtttagttaatagtaatgtaccaatgttaattttatagtttttacaaatgtgcttgataacataagatatcaccactggaggaaactaggtgaaagatgtggggtacacaggtgctctctgtacactttgaacttttgtgtaaatctaaacttatctcaaaacaaaaagtgtttttaaagcaaaacaacaacaaaaacaccccaaaaattatagtcatgggcactagattaaccttgaagcacagagacagatatgtaagtatgtttcttatcaatgatgtttgtaatcaatgctatgaagtatagatattttaagagcaatagagatgaaatctcaagcttttctctgatatttgctcttattaagtatttgtagcagtaacaaatacttcaccaataaccaccccaccctcatctcccttacacagacataaagacactcagacttctgaaacttatcctgatatctctcagtcacttctgcagctgagtagtcccatgcttcaggcccttgcctaggaggctgaagggggtggagaagctcccatgttatgccccatcataatcattttcttccagtgctctgcctctcccagcaaactgcttgccaccttttgcatcacaaaaatcacagtgcttttccacctctcatcctaatgaagtccacgaggatgattaagtggaccttcagaattgtggagaggggggaaacaaatgttagtaagagtatttttttatgcttggaatttgcatttgacacttcttaattactgttaaagtaatatccagattctaaatatcaaggcatactatgtttatattgtagattgtgtttggataattctattttctctggtatgatgttatgcttttgggacacattttcccactaaagtgggaagtgcaaacctatttaataatgatctcaacacagcacaatttaaaatgataattggaaatgatcttttgtacagcatcacgagataactatacaaatgaactcttgtatggttaataatgtatttaaaacttgaaaactgctaagaataaatcttaaatgttctcaccacacacacacacaaaaagacaacaatgtgagttcatggatatgttactgggcttgattgtggtaatcatttcataacgtatatgtatatcgaaacatcatgttgtataccataaatatatacaatttttgtttatcaattataccccaataaaactgaagaaaaaaagaatcaaaatatgcccaaaagaccactggaggaaaaaaatacaacaaaatgattacttctgggttaaaattctgataatgccactttgaacaagttacttaatgtccctgagccttatttttcacatctttaaagtagagataacaattcctaagtctttgtgattattaatgaaataacgaaccaaaatgtgggctgtaattgtacctattccatagggttagtacacgtaaatgagatgggatgtaccattttcgcagagtatctagagcacaggtagcacttaataaaatgttgaccatgtgctaacctgctaacaaggaagccctcacatgggctccattcttgctgctagctaacttcttttacaacatggctcattcataccatattaagtagaacaccattttgaattataggtgtgattaagtacttgctgattatttctaccctttctctccacacacatatcgtttagcaaacatctaaatctgatttaacaagcttatcttttactaggtggtttttcatattactgaagtgttttatataaccacagagattctccatagtttttcattaaataacttgctcgcattccttatattgaacctaaaacatgttaatttaccaaatgctaacataaatcaaagtttttaggaacacatctgttgtataaaacagatcacacctgtacacattgttaatgcacacatataaatagtaaaccaaagtatattattgtaggaaatctaaagagtaaaataataaactcctatttagagttaaaagtatgtaattaagcaaaatactgggtccatggtaactatgcaatcgaaaaatacatcaactgaattatcatgctaatgataaactcttctaggaatgactgtgaagtcattctgtctttgaaattgattatttatttcataaacctattgtattcatggaatctattttactaattatgagattattttatgataccttttgtttttatcataagtcagtgtcctcagtatatttagattctactttatgttgtgtatgttttttcattcaaaatgttctttaggaaaaaaaaaatttgagcagaaacaggctgtcctaggacatcctttcctttagagacatgagtttctccagcataaaaaaatgattggattccaaattggttaaatagcatcttctgtaacagtacagtcacatgttgtcttgttaccgtggaacatgtactgtcatttcagaagagccattctgtgaaaaagttttatttggcccacatagccaatcctcggatttgtggatgttacctcctttctgtgttaccagtttttttcatcatcattattgcttctgcttcatcagctgtaacacagtttagggcaatccttttaaagaatgagatgtttctcaaaatagacaaaacagttggccagacagaaaagagatatcaacaaaattaggtcagttgtttgtctgtgtgttgctccctgaaacacttcagagacacaccatctcacacatgtgtaaatgaacagacattgagtaagcatatcacctgtgcattccaatacaaatttttatcctattttattaaggaaagtaaatgatatgcaaagtgatttcattcagagaatacaggaccaaaacaaccaaataaattcttggttcggaccctctttagcaagccctctaggtgtttctgatgcaagctaaaggttgaaaaacactctgtagcaacacagaaggaataaggcacagtacttgcccttaagcacttctccttggtctcaaggaattcccagctgcttcaaatttgcattttaattacctagcacagttttatcatatataagcttagttgataatgataatattattactgcttaagagtgtaatggtttttcatctcttcttgagcagtcattcaatcaagtgtttattagaaagtagtagttagtatccattacaaaaatccttatgaatcttatgagttgagctgcattgttattgcttgttgcaacacacacatagagaaagaattataaaatataaaatcttaagggacaaatattttcaataaagaattttaaagtgatttttgtgttgtgtttaaattctagataatattattaagcttatacttgctatcttctcatgtttattaatataggttgtttacagctttctgacagcacaattaatatacaattaactatacatatttataaagcatttaatttgataaattttgacacatatatacatagtatcataaaacagtttgtagaggggctttcaattctaatagattacaagtattcattacttgtgcaagttttcccccttccaaccctaatttcgaagtgggactgcaaagaaggcttcctgagtaaagtaacatgagctgagatttgtaaaacaactggatacctgcccaagtgaatacaaaggggaagagttttacagaatggaaataaagtctatctcacccagacttctagacttctcacctctgacatctagacttatggctgttgtaacttatcatcacattgggttttgaaatatttactcaatttctttgtttcttcttataattccaaatgagatgagcttaacagggcaagtgaaataaacaacactgtttctgagagtagccatccctgcagtttgtttcttgcattagagtaacttgtttagctttgaccatcaatccactctggaattcatatttatatgctgtgtgtattatagagaacagcatgagtaaaattatattttcacttttaaagaatgaaatctaatagcttgcctttaatttcctttttaccttcttcttcctctgagcaaattattacctccccaaatgttcatttatcattactcccatgtgttaatactgagactttactttttcttctctcatttgctttatttcctcctttgcaggttggcttcatgagttgggaaagagactggaatctccatactatggcaacaataccttggggggcccgtcgatccgaagtgcctatattgccgctctgtacttcacgctgagcagcctcaccagcgtgggttttgggaacgtctctgctaatacagatgcagaaaagatcttctccatctgcaccatgctgattggtggtaagagagcatcttcttttatactaagaagaggaactatgcctacctaactgtcactgcctgtttgttctgtcctgaaatacaaaacagataaactgattaacactggaagattctaaaagcactaattagacagtctagatgcaaagctgtagttgtctctgtggttccatgtaaaaaaggacttgagagattaacacacaagagcatgcatttaagaagaatggagcaagattaacacgtggggctcctcttatgtagaatcattacctcatccagcttactgttttatcctgcaaaggtaagatgaagtaagaggtggctatgtaggcaaacttataatacacatttgccctgcccactaggatatgtactctggacagtggcttagaacctgaattttcctagatcctccaacttacttttacatatgccctctttctggtccacattgtggccttgaaactatggatcaagtctgtttcagactcttcactcagtttcttcatctttcaaatgaggtattaggcaagatgcaactgtggttctttctatctctgatgtaatgttatatgaccataaatatcattgctttctataaagcaagggtattagtaagatccagcagtacttctcccaataacaaaacaaatttcatttagatgtgaattgtattttcagtcttcgcacttctctccctaggcaactcattttataagactcaatgaaagagggtggttgattcagcaaacatctatccccactcctggaatgaaagccccaaatacacttactttggaaagctcaaaacattaaaaaattaggaaatttgcccaaaatgctctctagagaattttatgacaatcaaaaacaggaacaaatatttcttatatgaacataatgaaataatctgcattttatatttctcttcaaagaaatcaaatttttaaagcattaagcatattttttaaagccagtaagttcaatattctgtttaactaagagacagctatgattcataaatatacataaagtctgcaaaaactgagactcatagatggcaaacgtgaggagagatgggaagacttgacaagagggtctagcatgtcaaatctcagaaagcatcaacaaaaatacacttcctaagtatgaggttcatgatccaaagtgcaaaagctatcaccctcctttattgcaagtaagagcaccaagtgagcaagtttggtggagaagtagagaaggctcaactcacaaagaatcacacggaccattcatatttgcagagatcatgctaacaacagacaataattcaaaatatattaataaagttattgctgttattaaagaagaccacaaacaaaaagtatcttagaaaagatataataacagaggttaaagataagctaaaatagctaagcaaagacgtaaaagaaaaaagcaaagccatcttatgcacaaagataaaattgaagagaaaaaagggaatagatattgcaaagaatataatgagtcataaaggataaaaagaaggaaagcaaaaggaactgaagggaaggaagaaaaagtggagagaaaaaacaaaaagagacagagggaggagagggagagagataaaggatggaaggcaggcaggcaggcaaaagaaagaaagaaaaagagtgagtgacaaagacagaaagaaacaaacttaaaaagagtagagaaatccctaacagtagaaagcaggctaaggagaaccaacatatgtatattgcttgttaatacataaataaattttaataagagtcagcagattcaagggaagacttttcactatatagcattttacataattttttaaaaaaattttgataacatgaattattgcatgtaatttttttaagcaagaagaagagaactagctagatagaggcacaatagaaaggaaggaaaataacaggcttgattcaaccatttatgtattcaaatattgtattagttaattctcacactgctaatgaagacatatccaagactgggcaatttataaagaaaaagaggtttaatggattcacggttccacatggctggggaggcctcacaatagtggtggaagacaatggaagagcacaagcacatttcacatggtggcaggcaagagagcacgtgcaggggaactgccctttataaaaccataagatcttgtaaggcttatttactatcaggagaacagcacaggaaaagcctgccaccatgattcaactacctcccactgggtccctccccacaacacgtggggattatgggagctacaattcaaggtgagattttggttggggacacagccaaaccatatcaagtgtataaccaaatacttactgaatgtctattatatgccaacaccaatacaataataaatagtgaacatttattagttgtttttatgttccattctctgttctaagtgttctgacataataccataatttttaaagcaaatctttggggttggcactattattatttcatataacaaacagacaatttattatactattttctctggactccaaacccacctttatttatttgctttgtaatgctggggtttgtactctgcaaaactcattcttcttcgctagctgacctcagttgctttctcttatgggaggaaccaagggaagactggcaggcaggaggaggggaggagggactgcctgctctggtgtgcatgctgttccctcagtggaggcgggcacctcagcagcagcaggtggtttcagccttcattctcagaaccaaactgattggacctcctcagacaatcttgcatcagtcaggggcactatcttgtccaaagagaaccctggctccctgacactccacacagctcctgctctgtgtttctatgttctgataactgcacttcttccctttgtgtatccagccctaagggttaagccttctacatttgctatgtccatgttacctctatgctccctttttatttattcagccttccaaccccaggaaaaccagttctctatactgaattactgctgttgaaatatttagtgtaatttctttcttctaaatcttccaactgatgcagattgatattatccacatttttcagatgacagatctaaagtatggagaattaaagtaactttcccaatgccacacaaccagttagtaaagatgcaaggtttgaacccaggtgcatacttacttctctccttaaatatgtaaagggaaactttactgaactataagactgctgtgatggagtattaggagatgttgaagtctaccttgatcaagtaagcattcttcttaggctaaagttctgttaatattttctgccccacaatattcccctcaaagcctgttttagcatgtcctcttaatgaccttaattcaagatatcactttgagttttgaaccttataataggagatggctcctacaggcttccttgcatgagagatgtgatatgagtgtgtgggtcttaagcaatggatcacgcagcatacagtgaaatcaaagaagtataaaaacaaaccttccctcaaagagcttatgatccagtttggaggagatgggcttaaacatgtggaaagagttttaatgataccaggcagtaaatgctaagtgccacatcagttaggaagttcagaagcagtgagagtttcttggaaagacagtgccatggcacagttgttcaagtagcatgctggggctgcagcaactgtaacaagctcttggctgatgtagagcagtgacagcctagggagcagagaacaggaattctcattttctgaagagctacaatgtgccaggccctgtggtgactgttttatatccagcgttatgacttttataatttccattctctgtgatatcccatatttcagccaagcaaaatcacaagcattttgcagataaacacagtctatacttatttaatacttgcccatgtttcttctactcctgatgataattttgggaaatgctcaaagcctaattctactaatttgacatttcaaaaaatccataagataattgagcttattatctattgatccacttactgtattgtgagtagtactgaatcaaaaattgttaatgcacaaactattccctgctgttctctgtaggtaggtgcgacactgatcacaaggccaaaagatgtgggaaataatctgataatgtcactttgtttcttgtttgttgaatgtttattgagcaaatgtcctggtgcaaaatcagtgctcattggtaagtggcattaaaaaatttaggtgacccgagcagcacttaggaaactattcatttgaaagtcaaatgccatctaagtgacttgaatttattagttaaagcttttcatatttgtgtttgtggggaaataattttatattattgtgaaaattaccctggctaggaaaaatgatgcctgcattttaatatttcctaattaactaattaattgtaaaatgttgagaactaatcataagagctcacactattgagcactttgttcatttaattctcataatactgtgagatagagattattaataccccaatttagacataaggcagaagagatttagtgagtttaaatccaggactcactaagacctggcaaacttcttctaaaatattcattttattatgtactataaatttattttgtttacttaatttttataaatataaacaaataatttatttttaaaaagaaaaatctaaaatttgtgttaccatagacttaagtctagggtatctcactaggaatcccccacacaaggctgatgaaattgctaatggcaaggatgcaatatactagaaaaatcggcagtagcaatattaaatgagaaaggggactggcaaaactccagataattatcaaggacagagataatattgctcagtgagaagaaatgggtgaaaaaatgctgaatggatccacctaggagtcctctgggaacccaccagaatttccacaggagttgtacaggttttattttatatatatatataaatatacatatatacacacacacacatatatatacacatatgtgtgtgtatatgtatataaacataaactttatatatatgtgtatatataaagttttcatttaagatgccatataaacttccatataggcatctgtaattatggagtgtacaaaccactaatatatgggaggaatatttaaaactataaatcagagagatttaaagcaaaaatagtttctaaaaattatacatagacaaaaccatgtgaactttgagaacacccaaaacaaataagtaattctaatagcttcagatgaatatcagaattaatgagcgaattcaataatgtttatggacacaagatcaatatgcaaaaaatcaattgcatttctatatactagtaacaaattagaaataaaatataaaaaatgattacaaataattaaatatgtatgaataattataactaaaaatttgtaagacttctatacagaaaattacaaaacattagtgagaaaataatggaaggatgtacaatggtgatggttgctaacaatggactcacgttgcaaaaatatcagttgtattcaaagtaacctaaagactcaatgcaatcccaataaaaattccagtagatgtgtgtttgtgtgtgggtgtgtttgaaaattgacaagttgtttctaaaaatcagtggagaagagctaaaaccagtcaaagctatcatgaaaaagaacaaaattggaagatttgtgctacagatatcaaaatgtatttcaaagttacagtaattaagagtgtatggtgtttgttcaataacagaccaataggccaatgaaatagaagagagttcagaaacagactcacacatgttgtcacttcatttgtgatacggatgctactttcagtaaatgttgttgggccaaatgtatatctacctgttggaagacaaccttggtccctcttaaaactgtacataaaaattaattccaggtggattttgacctaaatttaggagggaaaacaatgaaacttctaaaaggtaatataggagaatattttttatgacgtctgatttggcaaaggtttcctaatcatgacacaaaacgccctagccttaaaggaaaagaatgataaattgaactgcagaacttcttttttatcaaaagaccttattataaatgtgaagagagaagctacaggataggagaagatattttcaaatgtttatctgacaaaggactctcatctactatatataaagaactgttaaatcaataagaaaaaaatcaatcaacgccctgaaatgggcaaaagcttgaaaaaaacacctcagaagtagatttccaatacctgagtagatgacaaacatatacaaaggtgctcaatgtcattaatcagtaacatgcaaattaaaaccaaaattagataccatttttgttcaccaaaatgatatgtttaaaaacactgcaaccctaagtgtttgagaggataatgaaacaccttgacctcctctcctatactgttgatgggcatgtcagtcgatacaactttgtcaacatctaccatatctgaatatacctctactctgtgattcaacaattccacttctgaatatataaccaatggaaatgcatacatatatacttcaggttatatacacagatgtctataaaagcatttttgtaagaatctcaaactgggaatgtccattaataggagaataaataagtaaattgtgaaatacctattcaagagaacattatacactaataagagtaaatgaactactatgtcatggaaccttatggataaatcgtacaaactcaatgctcaacagagaagccagacgaaaaaaagtacatattttatgattttgtttagagaaagtttatagataggcaaagcttattaattgtaatataattggtaactgtggttacctttggtgaagggattggttagtgattgtgaaggggacacagggaagcctccaggatactaatatttggtttatttatctcgggtggtgggaggtagtgattctatagctatgtttactttgaaaaatctcaatgagcttcacatttagcaaatgtgtaacttgttctgtatgtatctttgattttaattttaccttgtaaaattttaatagatgagctaaaaataatatatcaagcatgagttaagaagctagctaatagtgagctaagttcttgcctttcatatcagattgtttttaggtttgtcttaacaataatgagtcaagcaatggagtacaattatgttgtccaaaattttggtgataactgcaaaaatacccaaaaaaatcattttaaaaggttgactttagcgagtgagatggggatgaagggatgggtttggggctggactatttatcatagattttctaaaccatttgcttacaattataaaactttttaaagaaagtatcaaactaccagaggcacattgcagttccataaatatttatggcatacttaaattatgccaagagctgtgctagatgcagggaaaacaaagatgactaagatatgatactttatttcaaggagttcacagtttaataatggaaataggtacttaagcagatgatgtcctttgttatttctatttttttctattataatgcacatttagaaaagactggaaaacaaagagaaaaataaaattacacagtctcattatcaaaaaatagttttccagaatttccatacatatataactattttttgaaatatgtatgtataactattcatatttttcacaaccagacaaaatatacagaaaagattttctcatgtctttaaaaattctttcatactaagcagtgactgcttatagtcacctaatgagtttgccccagttgatagagtcatcagcacagccttggaggttggataaagcttcctagtaaagatcgttcatcactgataacatattcagtttcaatgaagcattattatcacaaagtaatcaaggcttccctcgggtccccccactgaatacacacacactaccctgacatagttttattggacccatatgatgagctattgtgttcacaaattcaggctgttctcaagatgtctttgcactgccatttaaattcattatttaagaaatttttctcatctctattctttctgccatctgccatccacaagccagtgtacttataaccaagaatggaaatttccagggcaatgaggaggtgggaaagagaaggagggcagctaagattacccaaaacctgagctctggcctccttttatatcagtagaaaacaccccctacttagcctccaaagccattgcaaaatagttggctaaagtaattagcaatgatgttatactccaggagataagtgttgtccaaaattcaggaaaagaaagagaagggggaagaaaaaggagaaaggaaatgaaaagagaaaggaaaagacaaagggaaagagaaagagaaagagaaagaaaaagccaggcagttctatagaagcacttctttcatttgagaactgcttactttcttcttagatgccaattgttgaggttccttccaagacctgatactgagatgagattttacaaaatgcattttatgcaaaactccaacacacaaaaaaagagacgcccacacactcagcaggtctaacactcaagaattatatacatcaaatttgctagaaataaaggaaaagtaagtgataatttccaaactgacctggatatagaagttcttgagtcaaactttgataacagatggaatgatgtttcctgacagttacacacactctttgccagggtgaaatgataaccagtgacagaatggtcataataactttggaaaatgaaaggctatgaggaccagaattttatttttttaactacttaaattagaagtagttatctatgctgaaatgagactttgaaattgtggtgactcagacatagactagtacttttcaacaacacttatgaatgctacaattaatccagtaattcattttactaataaaatacaactaggatgctaaataatctgaacatattacttctcttactttaagtgctttacacattataattagcaaagcaaagttaaaatcatacacataattaaggaaagcagtgttaaaataaatgaaacagaattgttctctgtactcgatttaatctccatggaaagactattacatagtgttaaagatggtagggcttccaaacacttagcccataagtatattaagggtgcctgaagtcgatgtttaatttctttgacttggagcagaatcagttcttttctttggtgagtgtttatcataagtagagctcttatcttccaaataaaagacttaagcatcagaactgctgtgcttctaaaacaatacagaagaatgaacctctatttagaatctacaaagaacaaatccaacatttagttgttacacgatatatatttttcgtggaatatttttgacctgttgggaaacatttaatttttgaacatttaggaataatacatacttatacattcttgcgtgtatcaagcatttattgagtatattttgaatttatttcatcaataagttatgtctaccaagagccgctctttactatttaagaggttgcaggaaaaccttaaatctgagtcattttccccaaatttaattgcattgagcatgctgaaaattcataacatgtttcactttcataaggaaaattacataaactgagcaaatactgtttttgatacatatactaggcactttttaaaaaatacatttgtctttaaatcttgaaatagccctatgagtaagggctatttaacataatgagtatgcccatttaacatgaatctgtttaaaggaattatgtaacctaccaagttcacacaattaggaagtagcaaaatcagtattcaaatccagatctgtctgattctgaagttcatcttctctctgcaacattatattgcttcttgtatatagaccctaagtttaaccctattctagtagcttttctaaaatactgaggtcttgttatgaagggagtgattttatagacatagtgaccattattccatagagaaattatgtattacctaggaaataattttaattccaatgtaagattagaattaagttagtatgccagtgtttggtaatttctgataaatgtagggggagaacaagatttgaattggggaggtcctgaaatactcaggaagatagaagtaataatatgttgacatatttgcaccaatgtatccattatgatgctaagaaatttttaacatagcttcttgggcactaaggttttgtacatgtacattttgatagatcctaatagacaagctactaaatgtttagtctttttttaagccccaaattactgaaacagatgattttacccaacacataagcttcatacttcattcctaatcctgtcccagaataaggatcagggataaaatctgaatattacttagagttgaattatccataaatatgaacgtgcttgaccctcatctttctctcagtttcacagttccaggtgtgtccaaggccttcttggattatctgctggtttagaaaccatttcggtttcattctgctaatgactagtgagtgcaaaatcctgtcataccttctctgacttgatgatacctagatgcttcccaaagtgggtaattcctggaaagtgaggtccatcctttcactctactgttctccagaagaaatacccaccctaaatctccatatgccctcaaattctggtgaacaaaattgttcatgtcattacactttgatggtaggtttgggacaggctcaaagggcaggcttagcaagaaactggaggttaaatactatctggttgacaaacctcattgaaacaagagtcccatatatatatatatatatatatatataccctgctggtgcatctcatggtggcaacaaggactctaagcagaatacctctttttctctgtgaattcatttgtttcttgaatggtctcaaattttccaatatctccctcaaaattaaaataactgcagagctggggttgggctgggtattggagcttcacactgctcaagaaatcctcagttacatttttaacaacttcctccatatctgcattaatataaatgtatcatatttaatattctaaaacgaattttaaatgatggctttttgagggggtgagactaaaattcccacaaaggctaactaattaaaatagacttatttcaaaaatttatttcattcattactattataaaagtaattattaaactataactttatagcttttctatcaaacaatgaagactattttattgtaactatcaaactatacataactattaaaataatatagatgtaaattgagttcaaataaaagtttatcataaccagaatggcagctagcaggttaaacgtaaatcaaaggggcctattttgcatatgattgagtatttttaaagatatttttactctgatcaagccatatggaatcaaagtgactgcttcaggatgtaccctgtgacacactgtctgtaccaaaatgcttgtaccaaaatagctgtatcaacatggccatgtaaccatgctctgctctgctctgatccaggataaactgtaaatttagatttacgtggtgggcctcatgtcacatttctcttccattatatactgtgttgttctttctagccttgatgcacgccttggtgtttggaaacgtgacagcaatcatacagaggatgtactccagatggtccctctatcacactagaactaaggatctgaaagatttcatccgtgtccatcacttgccccaacaactcaagcagaggatgctcgaatattttcaaacaacctggtcagtcaacaatggaatagattcaaatgaggtaatgttcatttctcatgttgttttcaggcagaaagcacatattctaaggtaaacgcaagatgttctaatgcaggtatcagaagtgaaaagcataccaacttctttattcctttacatttttaattattcatgaatcccaatccatcttctttcacttgctttggcttgtgttttcacaatgccaatttggattgaccgaagttttatattaacttgctgcttattcgatcaggtggatttattttccttcttattgtctcttttcaaaggaatcaattcttacgataatttaacagtgtaatctgggataattatattaatcaagtttctgtttcccttaacatcaataaagttaaaaaattccatcaaaggggttatctttatacttccagaaacaccccagactgccactataaaaacagtattatataaatcaacgaaccatttcatcaacccaccagccaaacctgtaaccaacattttagtagtgattaattggtttctcctctcttcgcataatcaccagtgggtccaaattccatatcttctgtcctgactaggactctctgtgagaaggaagtcacaatgagttatatgttttcctgctagaggcttttttaatttgttctgtttctccagacttcttatcagctgattattcagtagcacataattcacagtcactgaaaaatctctccaggattatacatacttagatttcctcttctgtatgctggatggccaaacagcaggagacagtaggaagagcatccctgctgtcttgcaaagtaaatcagttagactacacttaccccaatttgatttcctccttcatcttctctgacagcttttgaaagactttccagatgaactgcgttctgacatcactatgcacttgaacaaggagatcttacagttgtccctttttgaatgtgccagccggggctgcctcaggtctctgtctctacacatcaaaacctctttctgtgctccgggggagtatctgctgcgtcaaggggatgctttgcaggccatctactttgtatgctcgggctccatggaagttcttaaagacagcatggtgctggctattcttggtaggtctgaattgaaaaacttgtatgaaatttgactctggagcataaattaagaagatgaaatgggggaaaaaactgctattgagagtaggaaaagaacagatgaagacatgaactcaggagtattcctcatatgagtttagtgtgcctatgtgttatatccaacatattatttaattcttgcaaaaaaatccagtagtataaatattatctccattttagacatgaataaatagtactttagttaactagcccagatcacctagtaagaaaataaactcagttattttttattcctaaagccaaattattaatcatgatatatactgccttctggtgaaatagctgctcagttttaagagggcatttatttttgtggaaaattaattcagagaacacaaaaattaaattgtacctgtactagaaatagagcaaaggtgactatgtttcaagaaaaagctctcatagcagtcattaacctaatactgtcaaggtgactataggctctttttacttccttaaagaaaacttacaagatatattgtgaaaattttgtgccacagaattgactctcaatattaatacataattggtcttcattgaaatataaaaggcagttgacaaaaatggcatgcagagttaatgtattgaaaatcttatttacaattttatgtagggctcttttaaaaaccactctaggctgggcacggtggctcatgcctgtaatcctagcgcttttgcagacgaggcaggtggattgcttgagcccatgagttcaagaccagcctgggcaacatggacagaccctgtctctactaaaaatacaaataattagctggccatggtggcaggagcctgtagttccagctacctgggaggctgagatgggaggatcgcttgagtcccagaggtggagggtgcagtaagccaagatagtgccactgaactccagcctgagtgcagagagagagagacagagtctcaaaaaaaatcactctaatttttgtttgtttattcacctaacgtttattgaggacttatgaatgaattcagtactggtctaaacagtgataatgcagcaaaaaagaaatggccaaaatccttgcctgcatgaaaattaaactgaagtggaagatataatggggtctgagaccagccaaggtggtagtaatgatggtgagaggcaggtgaattcaggatgtatttcaaacaccaatataaaacacaatatttagagtttgtgctaataaaagggggtgaattcagtactttattttcaatttttaagaaccttgtatttgtaaacaattatttgcaaagtgtgctcacacacaaggtctcatttaagcctttacaacacagagagacagatggtgaaggtattttctctgatttttctaaagtcaaagctaacctaagactttggactctgtattcagcattccttccatgtctaaacaatatctatttttctaattttaaaaaaaccctgcactcatatgtttatcacagcactatttatgatatcaacaatatggaatcaacctaagtgttcatcattggatgaatggattaaaaatgtggtacatatatgcaatggaatactattcagccataaagaagaatgaaatcatatattttgcagcaatatggattgaactggaggccattatcttaagtaaaataactcagaaaaagaaagtgaaatactacatgttctcacttataattgggaggtaaataaagtgtacagatggacatagagtgtggaataatagacacgggagaccaggaaaagtggaagactggaggaggggcgtgagggatgaaaataaattaatatacaatgtacaccattcaagtgatggttacactgaaagtccagacttcaccactaggcaatatatctatgtaacaaaactgcacttgtatcctttaaatttatgcaaattttaaaaaaccattattctatataatcattgtaggccttctatcaatggattctggctactaagcttcaaaatagattatattttggaagagaaaaagagaactaatatgtattgaatccctcatatgagctgggtgttttatgcccattattgaatttaaatcatgcaatttattatttgtgggttatgatctgaatgtctgcgtccccccaaaattgatatgtcaaaacctaatccccaatatgatggcattaggggtggggccttgaagaggtgaataggtgatgagggcacagccctcgtgaatgggattcgtgtctttatagtagaggctcaagagagctaccttgccctttctcccatgtgcggacacaacggaaaggtgccatttgtgaatcacaaaatgagcccttaccaaacaccagcctgcagaactatgagaaataatttttttgtttataagctacccagtttacagtatggcaacctgaatagactaagacagtatgattattttcaaaattaaaggtgaagagatagacactagtgaatgatgaaagacccatatgcttttcacagcttcatgttgacttgtctaccacttagagtaaaggtagggtttgtctttcaaatttgtgactcagttcttgtctcatcctcttatgtttttctcctcaatagaaaggcatgaaatagcaactcagagtttactattaatgtggtcatttctttatcaatattaaagtaaggctcaataatagagtaactcaatattagagtaaggcttctgtgtgtgtgtgtgtgtgtgtgtgtgtgtgtgtgtgtgtgtgtgtgtgtgtgttttctttcttaaggggagaatttaacactcttcctggcctcttctcaagtttgggaagttaaaggccagtcaccctatcatcttgtgattctaaattagaattaataattattcttaatttgtttcaaaaacttaaccttaatcataaaatattttttattgattttccttagtaccactaaacgttttatagcctgcctaatgattcagcctgtttttaagagggcatctagactttctctttagcatcttatggttttgatattcatgttagcaaatacaatgcagcattctaaacagacataatgtgtatttttctataattgtggtgtattttaaatttaggtggctagcaacagttttaggaatagaatatgaaggcatcatccatgacactagagcacaataagtacagatttagtggcttctatgtaacttccattgctagtcaaatatgattcaattggatatttcttgttatgtttttttaaaaactacttacggctgaaagacttaattcattatcttttgctcctggccccaagtttctccataaattgtgattaacatgggtaatattttcacatctttgcttctaccatgtatacatcaaaagtgcaaattgctgcatgaccattctaaacactggtatgtggtactgggactaaactcaacaaagacaataaatgattaatatttactttctgtgattaacattacttcaataaagattgattattttactttccctatagcaatattgccttatagggctaattcaaatcaataatactttgataaacttagcaagtacatgacattatacttgacctgtagatatttagcacatgttcactctgccaatgaaaaaaagctaatgttcttcttcctcacaacagctgtccaaccataaacttgttctagcaactttcttgtccagtcaagatgtgcagacatttcttaatctgatacctggaaagggtaggggcaggaatttgttatggggctagaatgtgtttgccttgtacaccttgatttcatgtccaggtaatagtgtttcccccaccaatttcttcattgttttaaaagaaaatggcaaagcctgaataaatgtactctccacagaacattagtctgcctaattataactaaacgtaagttatagctctaacctgggtggtttgcagatgcatcccatcaccttatgtttttcaatgaaagagtaactgattagcaaagatcaatagtataatgctgaaaaatggagcccacaaggaaatctttctcatcttttagaaataaggatactgagacccaaagttacttaaaaacttaactaaaggtcctaaatctagacagtaagaaggccacaagactgtaaaattagtgaggtagttttaggtaatgaggtgaataccaacatggtattcaccagtacctgcttgccaggactcaatacaaggtccagcacgcgtggtcagttctccataaatattcattgaacgaataaatgaagtggaattctttctaggatgccaagattggcaggatgttggtgctgtttttatagctaatgtcattgtgactgaaatagccataccatggcaacccaaagtatgaaaagtatgatgacccgaaagttattgcagacactagttgcttagcagagaatgtgaatgcttattgtgcaagagactgcatcatgataaattctcctcaaatatacaaaatttaaaaatttgctgtattcaaaacattttggctatatttacatcctgcatcagtatccaactttgagttttgagcagcaagttagatttctaatgaaatatacaagaaacaaaatttccaagtttagcaatattgacaacaataaatcagacttaaattcttccacaccatgtggctatgtattattcctagtgtctataaatatagattttagtctactttttcttctaccaaaataggctaaatttcaaggtttaagtccagtactaacttgaagataatacctagttgtaatctaataattttaaaactctattttttatttgacatacatatttatgaaaaactcagatattcatagtcaatttgacatgttttcttttactgtcaaatctgataaaacagacttgtattgaagcctgctacataccagggactttgcttccacaaatgctgggcacaataaaaaataaaaattttaaacaatgctgggtacaataaaaaatttaaaagttaaaaaaattgttgaatgggaagtagaggccatttgtcataataacattccaaagatatagcttgcttgctgcttgttgttgttagttaaaatttgttagttgttggttctttatgaaattgagcataatggccataaaacaaataaaagctaaagcccaggtatgatgctattgtatgccaaagttgaaaagccctgccccaaggtaaacattcttctcttttcagtgtaatctcactgaaaaatgaagcctgtaagtcaaatgaggttatcagtcctaagcttgctttttttttttgaaaatgatctctctctctctttctagggaaaggggatttaattggagcaaatctatcaattaaggaccaagtgatcaagaccaatgcagatgtaaaggctttaacctactgtgatctccagtgtatcatcctcaaaggactctttgaagtgctagacctttacccagaatatgctcacaaattcgtggaagacattcagcatgacctcacatacaacctccgagaaggtcatgagagtgatgtaagtcccatttctaattagtgctaagacctaataacattgggcctggagatcatttgtaacagtaaaggcagatgtcatgacctcaccttaaaaagtctctgaatatctaagacgtgaatattcagccaccagttaagcaattaaataattagcgagaagccaaacctagagtttgttattaacattctaggaaaatatttttcatgaatgacttctcaactcagtttctttcttgtttcttttcatatgcttaaaactacaatccatttcagttatatataacattaggtagagatgtgtgatttctccagaatttaaagatttccagatgaagtatatggttcagtttgctgtgtttgtaattgttcactactccaattgcttgacatagattttgcttaaaaataatcttttatttaatggtacacaaaacagtctatcttaaagtgagtaaatatgcataaaaggattcaagcgaaggattgtcacactgaaagcataatgaacattttatgcaattatatatttgctgcaagtttcgtattagacaaacagctttcctgtcaaaatatgtactatactgcatcctgtgattaagctgatcgtgaacatgacttcattagatgtctcagagagagacatgatttaataggaatgattgttgaaaggcaagccaaggcatgcatagcattgtgtaacaacaagcctttatatgctgtcttgagctttgtcccagatatttgtaactcttgatttttttcctatgtacttaagaagctatggtttggaccaacccatattgtgcagatattcatgtcaatcattagtattctctgctttgaaaggtagaaagaaaacttaaattgtgtattattttatcttggttggggctatctaatgacagtaagtatgtagataatatcccattatgaggttcaagatgaccagttttgcatatatgcttctctccattgttgatagcaaacagcagagtaggtaccaacatttactggctatgttttatgtgttaagcactctacctatgtaaagcatctcatttattgcttaagacaaatctttaaggtaagtcttgatctatttttatggaagagaaaacaaattcagaatggttaaatcacgtgtgtatgttcacacatacttgcaggtggctgggtcagagtttcaacataggtatcagagtttaaaacatatattgtttctgttaaatatgttgcctcatcttgaaatccttttcatgtcttttaaaaaaaatcagtagattgaattttaaaactacaggtgtcttttgtgctcaccatgacagcataaaatgacaattgttttgaaaatcaaaggtgagttagggggtggaagtaatcaaagagaagaagaaattagcaaagagagaaaaatcgctaatattcctcagcatagaaagtgggaaatattggatctcaatctctattttatttcatttgacttattaaggatccttatctttttaaaaaattcgtggcatacaaaatgatgttttcaaatatgtatacattttggaatggctaaatcacgctaattaatgtatgcatttcctcacgtttatcatttatttgtggtgagaacacttaaaatctcctcccttagcaattttcaagtgtacaatacatcgttattaactagagtcaccatgttgtacaacagatctcttgaacttatttctcctagcttaaactctgtatcctttaagcaacgtctttctaatctcttctggacctgcagccccagctcatggtaaccatcattgtactctctgcttctttgagttcaaggtattttagattcagtatataaatgagatcatgtagtatttgtctttctatacgtggcatatttcactaagcataatgacctccagtttcatccatgttgtggcaaatgacaggattatcttcttttttaaggctgaatagtatttcattgtgtatgtataccacattttctttattcatttgtctgttgttggacacttaggttaattctgtatcttggctattatgaataatgctgcaatgaaaatgggagtgcatatatctctttaagatactgatttcattcctttggatatatacccagtattaggacttccagatcatatggtacttctatttttaatttttttaaagaacttccctactgttttccatagtggctataatgatttacatttgcaccaacagtgtgcaggggttccttttttttcacatccttgccaaaatttctttgttgttgttttttttaaaatagcccttctaataggtgtggttttaatttgcattttcctaatgattagcaatattgagcatattttcatataactgttggccttttgtatgtcttttcctgagaaaagttcattctggtcatctgttttaaaaatcaggttatttaatttcttgttattgagttgtttatgtatttattgttgttactgagttgagtttatgtattttgcatattaactccttatcagatgtatgatttgcaaatattttctcccattctgtagattgtctcttgattctgttgattgttccttttctgtgcagagcttttaaatttgatataattcaatttatctgtttttgcttttgttgcctgtgctttggagtcatatccaaaaacatcattgtccagaccaatgtcatggagctttcccctatgttttcttttagagttacataatttcagttcttacatttaagtctttattcattttgaatttgtttgtatatggtgtaacataaagatctaattttattcttctgcatgtggaaaaggaatttttatctttgataaaattttcatgattctttttctatcttctagaacattaattatagtaatttaaaaatccctgtatacctgaattatctctggaattatttccattgtctgttatttttctctttttctgtctctctctctctctctctgtcatttgttcttttttggtcatttagttctcattttaaaaaaggaaaagcgggtgtcagaattttgtttaaatatagatgttgcttattaaagattgttcatgtcattttcctcaaaataagattttcttttcacaggcaaacagtatcagcaaaccaacttaatgctgaccatagtttattttaggctttgttaaggtggcatatttcaattttgccctcaatcctgaggtctagcctttattcctaaaacagcttttctggagtctcagctcaaaccatagtatgtttaccaaggctcttcctatttagcagagcctgagctccagcctccatctccccaacaccacgtgactgctgaaatctctatcctgtaatttagccttctaggtgctattttaatctgtttcttagagtactaccccttgctgttcaagttaggagttggctaatgccttaaagggaacatcaatgcagtttacttctctctggtattatattcctcaaatcccttatgctttggtttacctgaacttctctgtctccttagttggtaaggatggtcctttctcatctcttctattctatcttacaatgaaatagcaagtgcctgcagaaaaactcctagccaaatgtgatgctctcattggtgcacttctcttttcttagggatcacgtccttcaagtcttaaagttgatttctctcaaattccttcaagaagtttcatatggtttgactgtgtatctcatcttgaattgtagttcccataatccccacatatcatgggaaggaccaggtggagataattgaatcatgggggcagtttcgctcatcctgttcttgtgatagtgagttaattctcataagatctgatggtttcataaggggcttcccctttcactggacactcattcttcctctccctgctgccatgtaaagaaggacgtgtttgcttccccttctgccatgattgtaagttttctgagacctccccagccatgctgaactgtgacttaattaaacttaattcctttataaattacccagtctcaggtatgtttttattagcggcatgagaacagactaatgcccagttattttactaattttgtccagtttgataattacttttgattggagggttagttcaatataagttacttcattatggctggaaccaaaagtattgcttcttttcaaagaggactccttatgagttacattttaaaggcagatgggaccttcattgttttatacttcctgatgttttatccctcaaaacttctatttatatataactgagagtctaggggatactatgccctctaagggctagataagtttggacctctgtttctataagtttgtacctaggggaaaagtcttgtgcactccccaagcatactgtgactttcaggggaacttgtattctgatgattacattatggattcctgttctctaccctggtgtcagactaactgtagaagcaagcccctttccttgattttcacagacaaaaccaaaaatatccagtcacacaggattttctgtggttaaaggctttgtggaaatttaagtgatgggttgtgggaggaggaacatttgcaaaatggaaatgtacacaacataaatgtaacttatctatacatccttatttttaaaagtcatgtggccactctgccatgttttttgtttctttgttattatactttaagttctagggtacatgtgcacaacgtgcaggtttgttacataggtatacatgtgccatgttggtttgccgcacccattaacttgtcatttacattaggtatttctcctaatgtcatccctccccctcccaaccaccccacaacaggccccagggtgtgatgttccccgccctgtgtccaagtgttctcattgttcaattcctacctatgagtgtccttgtgatagtttgctcagaatgatggtttccagcttcatccatgtccctacaaaggacattaactcatccttttttatggctgcatagtattccatggtgtatatgtgccacattttcttaatccagtctatcattgttggacatttgggttggttccaagtctttgctattgtgaatagtgccacaataaacatatgtgtgcatgtgtctttatggcagtatgacttataatcctttggatatatacccaataatgggatcactgggtcaaatggtatttctggttttagatccttgaggaattgccacactgtcttccacaatggttgaactagtttacagtcacaccaacagtgtaaaagtgttcctatttctccatatcctctccaacatctgttgtttcctgactttttaatgattgccattctaactggtgtgagatggtatctcattgtggttttgatttgctttctctgatgaccagtgatgatgagcatttcttcatgtgtctgttggctgcataagtgtcttcttttcagaagtgtctgttcatattcttcacccactttttgatggggttgtttgtttttttcttgtaaatttgtttaagttctttgtagattccgggtattagccctttgtcaggtgggtagatggcagaaatgttctcccattctgtaggttgcctgttcactctgatggtagtttcttttgctgtgcagaagctctctagtttaattagatcccatttgtcaattttggcttttgttgccattgcttttggtcttttagtcatgaaggctttgcccatgcttatgtcctgaatggtattccctaggttttcttctaggggttttatggttttaggtctaacatttaagtctttaatccatcttgaattaatttttgtataaggtgtaaggaagggatccagtttctcatatggctagccagttttcccagcaccatttattaaatagggaatcctttccccatttgtttttgtcaggtttgtcaaagatcaggtttgtcaaagatagatgtgtgagattcaaccaaccaccaatcaaaatcatcaaaaagtggtgtctgtactaaatatgtacacacgttttttcttatcataactccctaaacaatacagtataacaactatttacatagaatttacattgtattaggtattataagtaatctagagatgatttagagtatacaggaggatgtgcataggttatactatgccattttatatcagggcttagagcatctgaggattttcatatctgcaggacgtcctggaaccagtctctcagatactaagggaccactgtacctatataatgataattcattgcaaaagtttcagagtagtcctatgcattaagttaacacaaatataaataaacataattgaatgcaaaagtttcatactagtagtatgcataaagttaatagaggacaaaatggaagaatatatccataatgtctaaacccataagggtttggtcaaaaagtaaaaagtattactgttagaaaaatgggcaaaatatatgtacaggcaatgtgtagatgaagaaacacaaaagacaacaagcagataaaaaatatgctcaaaaacattagaaatataaaaatgaaaataaaaaacaaaggcgtaaacttttaaattcttagaataccaaccttatggagaagattaataaaagtgtataggaacttatgcagttattggtggagaatatagtcttgtgtatccattttgcagaaaaatatgtcactacttagtccatttaaatatatatacagcctatgacctctcaatttcaaagtgtatccaaaaattttacatacaggtctataacggggattgtatggggatgttcattgtagctctgcttattgtggacaagagttaaaagcaacctgggtattcatcactggaagaccaggttcaataaaatatggtgcataacagaattctgtatagcagtgacagtatatgtaagtatgtaaaatgtaggatttattgacaagataagaaacagaatgatatctgaaacaataccgcttgcgtaaattaaaatgtactcaaatcagtgtacaatttcctaagctaattataaactaaaataccagaggactttctgtacattgaaataccaaagactgtcaatacctaagacagtccagaagaagaacaaaatttgaggatttatgctgtcacactaacaaaactttagaaactaaacctacagtaattcaaccaaagaggtatgaatgcaaggctgtacaatttcaatagaacaggttccacaaacaggcccacactttatggtcacctgatttatcacaagttgctatagtgaaaaaaatggcagtttagactatcaattaatgatgatgtattaacttaaagcttacatggaagaaaataaaccgtggcctaaaagttggcccatgagatacttaaaactcaattccagatggattgcagacctaaacgaaagaaaaaacaataaagtttctagaagaaaacattgcagaatatcattatgaccttggaatagcaaatatttcttgaggaggacatggactgtaataacaataaaggaaagagaaatttactaaaatgaggaacttttattcatcaaaagacagcagtaacagaataaaaagggaagctgaagaatgggagaagatatttgcatcacatatatttgaaaaagaaagaatatcccgaatgtattaaaactcctaaaaataagtaagaaaaagacatatacttcagtttttaaaatgaggaaaacgatcaggcacttttcaagtggctgatatccaaatggccacttgccattatccaaatggcatatccaaatggccaacagtttgatcatttacttcttgtacacctcttccctcctcagtcttttatctaagttagtaaatgacatcatcatctactctattgctcatagtaaaataatttaataaattatagtgagaatgatatgattagtatcaagataagtaattgagattagcagaaatagcacccaagatgccaaaataattaaaaggaaatatgaataggtaactcaagaaaagttttgaaggcattacttagaagattttcttttcttttattctgcttctctatatttcaataatgctggagaaatctttagcaattcataagttttacttgtcaacttaaggaagaagatgccatctaggaatttcatagctagagaagtcagtgcctggcttcaaatcttcaaaggacagactgattctcattaggagctaatgtagctggtgactttaagttgaggctaatgctcatttgtcattccaaaaatcctagggcccttaagaagtatgctaaatcttttctgcctgtactctataaatggaacaacaaagcctagatgtagtacatctgtttacagtatggtttactgaatattttaagcccactgttgagacctagtgctcagaataaaagattcctttcaaaatattactgctcattcattgacagtataccttgttacccaagagctctgatggagatatgcaaggatattaatgcagttctcatgcctgctaacacaacatctattctgtagcccatagatgaggtgtaatttcaactttcaagtcttattattgaagaaatatattttgtaaagctatagctgccatagatagtgatttctttgatggacctggatgaattaagttgaaaacactctggaaaaattttggcattctagatgccattaagaatatgtgtgattcctgggaggaggtccaaatatcaacattaacaggagtttggaagaagttgactttaatcctcatggatgactgaggggttccaaacttaaatgaaggaagtcagtgcagatctggtggagatagcaaaagaattagaattagaagtggagcctgaagatgtgactgaattgctgcaattttatgataaaactttaacatataagaagttgcttctttattttattttatttatttatttattgagatagggcctcactctgttgcacaggctggagtgcggtggcatgatcacagctcattggagccttgacctcctgggcccaagagatcctccaacctcagcctcccatgcacgggcatgcaccaccacacccggctaattcttttttatatttgtagagatgaggtctcgctatattgcttaggctggtctcaaactcctgggctcaagcaatcctcctgcctcagcctcccaaagtgttgggattacaggtgttagccaccatacccagccaggagttgcttcttatgaatgagtgaagtggtttcttgagatggaatctactcatggtgaagatgttgtgaacattgttgaaatgacaacaaaggatttagaatattacatgaacttagtttataaagcagtggcagggtttgaaaggcttgactccaatttcaaaagaagttctactgtgggtaaaatgctatcaaactgtaccgtatggtacaaagaaatcactcatgaaaggaatagtccaattgatgtcacaaacttcattgttgttttattttcagaaattgctgcagccaccccagccttcagcagccaccaccctgattagtcagcagccatcaacatcaaagcaaaacccttcaccaacaaagagattataacatactgcagactcagatgattgttaacattttgtagcaatacattttttttttttttttttttttttttttttttagatgaagtctcgctcttgccgcccaggctggagtgcaatgacacgatctcagcttactgagatccatctccctggttcaagcgattctcctgcctcagcctcccgagtagctgggattacaggcatgtgccaccctgcctggctaattttgtatttttagtagagatggggtttctccatgttggtcaggctggtctcgaactccctacctcaggtgatctgcctgcctcagcttcccaaagtactgggattacaggcgtgagccactgcgcccggccaataaaatatttttaattaagatatgtatgttgtttttagacatacataagtctattaatgcacacttaatagactacagtataatgtaaacatgacttttatatccactggaaaacaaaaatttcatatgactcactttactgagatagtaactttattgtagtggtttggaagtggtctgaggtatgcctgtatcataactcagtttcaggggattcattgaccctttcaatatcgtatagagagtccataaaattccaattaaaaatatacatgttaaaatatcctgagggaaatatagtggcccttgtctcctttcgcagattcatgtataagtagacacacacacacacacacacacacacatgtgcacacacacaaatatataaccaagcaacctgcaaagaaggcatgggataaacatcattaacagctgccatttctgattgctttctctgtgatagacactgtgtatgcattatctggtgaaatctttgacagtcatgcaacttgggtacagttatattcaccagctgtacaaagtatgtgtttcctttgtcaggaataagctgaactctaatgtatgagtcaacttgccttcagtagcccatgggggcagggaagaatgtgtttgtgggagcacggggggcatggtgggagtaggagctgaaacatacctacctgaccatgacaaatgagattcaatatagtgattctccctgcctccacttgtatcctcttatgacctcaaggctacaggagtaatctttgtaaaatataaatcaaactgtctcattttgctgcttgaaatagatccccatgggctggtagtaacatccagactttttatcataactttcaaggttctaagccttcctttcccagcctgcctttcaaagtcatctgatgccatcttgcctccagcattacactccagcaaactggcctgctttcccttccttagggaggcaggctccacccacctcactccctccctcccctcctccccacctctgctgcctcagggcctttgcatttgatcttctttcttcctgttgtgctactcctctgcccttacctgacagtctgctctggagtttgccctctcccagttatcctctgttatatcaccttgtttgtcttttttcatggcatttagcaggatctaatattattttaatttgtatattttcttgctcatgattagtttctcctaccaaaacctattttatgaaacctttgtcttgttctatactatagccccagtgcctaggtcagagcctaatgcagagtcaacatttaatatatattcaatgaatgaatgaacaaatgtcaataagtttactttggtgcctggaactaatgttaagttttaagaaaatgaagaaagtcctgaagacagcggcctctatggccagtaagtagagtctaaaatgagaagcaaaaaacaatttaggattatatctgttagacatagcaaagccaaaaaaagtatcaatactaggatttgaaagaacaaattgaaagaacggctaaattgaataacaacatttttcacttcccctaagttcaggaaaagagattttcaaaagcaacatgaggaatttaagctgaataataggggaaaaataaagattgcaatctgagtaatatttctccaggtggtttgatatagtaagtagggttaaaataaaagatctgccttcaaatctcagctaatgtgcccattttctacatctaatttccatgaactattgagttacgtctacttgaacctcttggcactgggcaatttcttgtgtaattaagctgtgctatatccatgagattcgacttcatgattccttccttagataaaaacaagcctgactagatctttcgaatgaagtttttgatttgcaaacatctcttgatgcctatgtgactatattacgatttaattcaattcaagaatgtactgaaaagggagctattccaagaagagacttattttaaatttagtccccatttcagtctgaaataaaattgggctgcttagaagcaattttcttgaaaatgatttattgaatattaataattttttaaatcatatctgacagcccagatacttaattcttcaaaagtagcctgtgtgtaggtgtgcatctgctagccgagtcctgcataataacagaacataattaattcttcacttttctgagataattgttcttagaaaattgcatactaaaggactcacatgtcattttaccatgtcagctttccttgttatctcaggcccaacaagtgttttgtcagttgtgtactttaaaatactctccctcaggaagcaaaaacacttccatgaaatatcttgcagtgaactgttttacacttttatgctgcttaagaaaatgttagataggaaaagctcattaaataatggcctgggaattgtacttggatccagtatgttttttttgttgttgctgttgttgttttttgttttttgtttttgagatggagtctcgcagcatcacccgggctggaatgcagtggcgcgatctcggctcactgcaacctctgcctccggggttcaagtgattctcctgcctcagcctcccaagtagctgggattacaggcacccgtcacagtatgttttttatattctgaaactttcctcctactgatgtctttcagtagattcagaagtgattgtggcaaacatagtatcttgaaggaagagatcgtgttttgattagcatctcccgagcctagttttgtgtttatgttcatggtattgaggaaataaagatcaatttggacttcttgcacctgttaatacatcctagttcctgactgcagcaaaatgactctcagtgccccttctcttcttagtgattgcctaagatgacagcttcattccctttattattatccaccttcttcccatcttcattgttttctcagtgaggactggactctactggactccactggagtccaaggtcatgttcccttgtaaccctgaagttctagactcctacctcagaaaaatgaaagcttgatactccataaatcaaaggaaagtagttactttcaccctttctcaaattatatttaatttttttttaattcttattttaggatagaactagtgtgggacattgcaaaagggccatcctgggaatcctgttaagtttggaggtaattcagaatgaggacattgattgtaaacaatagacattcaactcaaatatagcattaaaagaaggggagatttaatgtaagaattccaagtatctaatgggatcaaataaaacacatgcacacataccacaagtacccgctggatctcaggaactcttacagtcaggctctcaaactctaaacattatctctctgtttcttacttttccttttctctgcatttcctcttcattcttctctccttcagtagacttgccatcttatttcctgcatccaaatggcagaaatatggtctcagacatcagctcttcaatttaaataggagcagagtaaggtggactttcttagttgattctagattcttgtgtaaagactctgagtggttcagatttaagtcacatgcccatccagctttcactaattattgtgaatggcagagtgatcgggggcttcaaggatgaagagagatcaccctgtagtagcatggtggtttccatggaatccctgagggctgaagagttgagataagagacaagaacgagaaagagggtgggtaggcagaggtagctgctggacacataaagcaaagatagaaattgtatgaattgtgggtctcctttgtgctgtggcattatagtttgtctccatgcaatcatatctcagcaacattttcacagaaacccaatcccttataaaaaatatattaaaataaaaacatattaaatagggagcacataaaaagctttaaaatatgctgcagtggctcatgcttcatcttttctgggttctctcctgtgtggcctcttgttagtcaaagagcacgacatataccctgcaaagagatcaaccacatttttagtggcatctggatatttcaacttacgtttgcaagttgaacagtaagcagttagatttttaagtttgtttatggggaaggggagtttagttgggctgggaaagggagagaaagaaaaggccacctgccataccatgaacaagacaaaaaagtttttctttcttttcttccttggttgcttccatcctgaagagaacagcagatgttcagccttaaataaagtgttaaatttgcatatgcacacacatacccacaaacaggcatggctccatttacatgtattccttgagaatgaaaaacaacctactgctatatccaccaggaatccgcatacctgctctacggttacttggcaggaagagggggatgtggagcaagggtcgtccattccatgctacattctggatagttgtttaggcctatgaagtgcagtgtttgccctctgtagagttcttctgcaggctgggttaacaaagccacacactcacgacaaaggctccatgaaaagaggatgatgtacatactgttgatagtatagtagctcctaggagccaagctgcatgctaagcactttacaaacattaacttattctcacaacaactttagaaataagttgtataagtttatgctctagataaggagactaattaaggatgaaagaggaaagaaaaactggtccagaatcctttagcaagtaagcaagggagatcaattactggaatttaagtcccaaaccacctgacttcaaaacccagttgaaacttagtataagtttatccatcaaaacaaagttattgattcatggtcagttgcctaatcctgtgattactgaatgccagctaagttaatggagcattcataggaaacatgtttccatgggagaatcagcttcatgagccaaatacgtaagtaaaaaatgaagcacagcactttttgataatttattaagctgtacacttttgacttatgcacttttttctgtatgctatacttcaattagaaagttttttaaaaatgaattataagaattctaccaagttacaagtgaataattcagttgtgcacatatgatttccttgagaacagttactgtattttaattcatttttgcaattctttttttaatgggattgctggtacaaagtatgtgcttgatgaaagcttattggaatttaatcacttcattcgtgtgtgtgtgtgtgtgtgtgtgtgtgtgtgtgtgtgtgtgtgtgtgtgtgttaatgtccacagaataacagaatgttagaacacaaaggcactttatataccatccagtaaagctttttctttggtgatatggtctggctctgtgtctccacccaaatctcatcttgtagttctcataattcccactgttgtgggagggaccaagtgggagataatgaatcatgtgggcaggtctttcctgtgctgttcttatgatagtgaattagtctcatgagacctgattgttttataaggagtttcctgcacaagctctttttacctgctgccatccatgtaagatgtgacttgctcctccttgccttccaccatgattgtgaggcctccccagccatgtgggactgtaagtccgttaaacctctttcttttgtaagttgcccagtctcaggtatgtctttttcagcagcatgaaaatggactaatacaattggataacaagtggcataaaaattcagtcactgattagatatataatataagtgaattacatacctacgttaatcagaatatctcctttgcagagaggacattcacatttgggtaaatctcccatgggcatcaagcatgtgtttcaaataagatttagtcaaataaacaaaatacatctcatctttttttactttctattgtcaactgaatatttagtagcatacctacttgctacatagaggtaagaatgtcaatgttattaagtattatgagcaaggtaatttgtttatattaccttatttaatttaacttttaatccttgcattgtttctgggagttcggattattttttggcttcccaaacaagggaactgaatatccaagtagtttactgcctgagattacaaaattagtgaaagaatcaaacagaataaaatcaagtcaaactcatggtcttctgcatacaagcctaatacatttgtccactaacataatctgccacaaatcagagagaaatgggttagtcttcttctgatttatagcataagctatactgaatttctggaataacattcagtttaattttctttaacttaattctattgcttgtcatatctcatcagaaaccgactggaactaaacattttaggaaagacatctgattaacaagaggacaagtaaggtgacaaaatatccataccttggccatttgacttgcctgctccccttgtatttgtgctcttatttgcttgtaaatccatccatttattaaataaccctatggtcacagactggctctgggagaatttcttccaactcaagtatatgtttttcagtctgctatttacattattgttcttcatccttcccttgctccatctttaagagtaaatttgtgaaatcaccactccactatcatttcaaatgtaaaaaacagtattttactttcttcccagactgtttcattcttgtaagaagatgcaggtcttcttattagtggaaataaatgaaaatctctttggagtgtgaatgtatcatatttgccaaccagtaacacattctgagaacttcttgtatacacacacaaactgatgcacacacatacatttatgtagagggattgagaacataagtgaaagaagcaatgtctttaatttagattttcattcacatttttccgtcaacctgcaaatattttacctgtggatatggatatgttaggactttttaaaacgtaattctattatgctttctgtccaagaattatgctttttgtccaggattttaagaataatcctgaaggttttatcatggtaaatatttcactgtttgaggctgtgccaggataataacatttcacaggtcatccttaggcatgtggggcatttcttctgttggccctctaaatcccaaaccagttatccctttaatcccagttctcaaactcaactgttagatttagtgcatggtatgattaaaactgtctacatgagctaagttgatggaaattaaatttaaatttaaaacaaattgcaaaatcccaggataaacatatttaatagtgcttttcccacaaaattccccaaaagggtgtagacagcagagaggatgacatatggtggaggcagtctgcttacagcgcagcacagactgtgctcagcaggcagatctggaggcctccagtttgatcagattcaaggcatctatttgctcaccatttaaacccagcatgccaggatgccaaaagagcggcagctttgagtggaggaaacagcagccaagtcattagaaatacaaagcaagctaaatttcaaattaaggggaaaactgaagtacctcgaaattatgaatgtgaaggccagcatgtggtgatgacaactctgtaagggtcaggggacccaggaagatgcatttctgtcaaatgaattgggattcaaagggtttggtttccaggtcattgaagaaaataattaaggaaaattctgatatgaatgtatacaacatactaaacatttaatgatgtaattccacttgtattttccactgttaagattaatgtctttgaaagcggaacatatgatgactgattcgtgtgactgcattttgccagcattcataaacagtcccgagtctgattattgctaatgaagcatatttatatcctaggttatacagtttacattttcctttgaggctaatattcagtcttccatcttgatagtacaaaatgttagcatcatatatagagaacaacgaaataggattctatcaaaaagagcaatgaagaggatccagaaatcctgactattagactcaatacacatacaactaaggccagaattgttcctccaaagaatctaaagctttgagtttcctgcaacccccaaagaaacaactaaacaagcacagtttgatccaaaagattggaagcttaaagggccagaattgcacaaatttttgtaaatattcattgaggcatcatccttccaatggggtcacttgtctatattttgctaaatgaaaataatagtcttaagggagagaaaagcttgtcctgaaaagaggcttcatgtgtataactgaatgatgactttgtacagaatctataaataactaaattaagtagttctgtctattcagaagttatgcccattctaagtgaatttgccttgttcactgttcacgtttttacaaagagaagctcctcatatccctgtgatttttcccaaatttggaaatgctgactttgtaaccaggttgccatgtgataactctaaatgcttgtccaaatagtacaatttcaggaaaagaaccattgattcacccttcttcccacaaatcttgtccctaatttcctcactgtttatttcaaaaggttaagaaaatgtctatcctatgatgaaagctcaggctcaaaatataaactcactttaaaaattaatataaaatacacgagactgtgtaaataactggagaataatttctcccccatggaaaacatgctccacaaggaaacattcttgagaaagagaccgagggaaggaaactagagatttatcaggcatattttatttatgacataattcttgttctgggaaattccttctttaggagaactattattgagggagcaaaaatgtcaaatcagatgtgtttcattctaaatttcagtggcttgtaatcccattacgaattctctcaaagacttgtttttagtcaatatataactagccagtaacatcttccttctgatgctccacgcaccaattttgagtacaatactgtagtataagaagattggccatacgtctactacctgtgagaatatcttcctcacctgaaaatgactatttggtaaaagtgctaattctatgatgaataattcttcaatcttaagtttcgaagatttctttaagtaaaacaattatgcatttagtcatgtggaggatgcatatcaccccactatcatgaccctctattagccctcttcttcttttgtggctaattgagcttaaccgaggcaatatatttcaaatcagcaaagtagtttatttcagtttgctggttcaaacactatcttcaacagacaaggaggttcaacttttttgttgcagtgtataattgacaatgggcttcctaggcagcaaattaggcatttcgcattaacgctaaagtgccacagggagttgtgatgcgcaaacttcttgcactaaagtgagcatctttcttaaccgacctggtttgaaacctaaatactcggtgggtatcctgaaaatcttatgaaaccgtctattgtgtttctttacaattacacagtagctgactttacaagctaagtaggagccattgtaccctaatcagaagcgggtcactggggggcatgggatctcagcttaatataatgaatttaaacagtgtaaattcttttcacacagattaccctgctgaattcccaaatcattgatttggggcatagcttcttaagcttgaaatctttaaaactcttacatcattgctgagagatttgtagtcagttttcttcacataatagtgtgtatttttctcctttttccttctagaatgatatgagccacgtattagtaaataaccctctttccctcaaaatcatcctgcattttccaagcttttaaataggtatcaagaaacttctttggattttctttcaatttcaaagccttgtagtttaggtaattgcatccaaagataaccattcttgagttgatttgtatatattgtcaatgtcttattgactgtattcacacccatgaacagttttactttatttaagtaaagcatatgaagggactgagaaagaaaaatatggaatgcctggccatttctttatataaagtattcttcctagtgttgtgcaaagaaaagtgtgttttgtggcatggcatgatagcccttttgctgggagaagaattttaggaaaactgttatttaagtatatggcctatttattaagacattgtacatatttattgagcaagtgggacggacccatgcatgtgaatgttgagataatcatcacccagctaaatgactgatgtaaaatatcataatgctccattcccaacatgaattcaattcaaagaaaacttttattcataatcaatatatcaataaagtataattaatatttataaacaagaattactcttgatgccagacattggaccgagaacttaacaatgaatgtgaggatttttttggttttctttttttttttttaactgtaatttctatgtgagaattccgtgtggaaggggaccctgaagttgaagggatatgaggcttacactgcccaacaggctccaaatgctttctctctggagaaatgagagacctggaaggcatgacactatcacctctagcatgacactaagacctctaacaggaatgcttggaattatggccaggtggaagcaacaaacaaggaatccagaaagagtttcagtgagagaattaagagagatgcatgattattattgctaataaaattaaaaaggaaggttaatcttaagatgtcttactatgagttatcaaatacatcttcttctttaaatctatttatttattatttacatttaggaaatacaagtacagattccttacattcatatattgcatagtggtgaattctgggctattcgtgtagccatcacctgaacagtgaacattgtactcaataagtaatttttcaaccctgaccccctggcacccttttttcatctccaatatctattattccactctgtatgtccatgtatacccattgtttagctcccaagtgagaacatgcaagtatttgactttctgtttctgagtcacttcagttaggataatggcctccagttacacccatgttactgcagaaaacataattttattttttatggcctagtagtattccatggtttatatacacagtttaggattcataggcccattttcttcatctgatcctccactgatgggcctatgaattctagattgattccatatctttgctattgtgactagtgctgcaataaacttatgaatgcaggtatcattttgatgtaatgatttcctgccctctcggtgtatacccagtagtgggattgctggattgaatggtggtactatttttagtttttgagaaatctccatactctttttcataaagcttgtactagtttacccaccaacaatgtataagcattcctttttctccacatcctcaacaacatctgttgttctttgacttttaataatagccattctcactaatgtaagatggtatctcattgtggttttaatttgaaatgcaccccttttaagggtcttgaaagacacacacaaacaaaaattagaattacattttaattacatttggtttctatactgcatttctcttaaatgtaacacaagccaaatgtggccaactggatctccattcagttttcacatatatatctcatttaattctcgaaacaactccagttattgccatcacttttgagaagaggaaatgaacgttcccaaaatttgactgtaagactagttctagccactaaaatgtaaatagaagtcatgtgtcaccctaggctggggtagtcatgtgcccagtatgccttccccatactgtctcctgagctacctattggataataccagaaaaatcctgagaccacaaaacagaagcagcctaggtccctgaatcacctagggattatgttagcggagaactgctggacatataacactgtaaatgactgagaaataaagttcttttgtgtaaaatttagaacattattgttaacccagcattacctcctctatcagaattaatatgtttcttaaggttacatagctaataattggcaggactaggaaaatattaatcactatgctacccaacctcctaagtgggttccatcccctggcgcacagaccttttactctaacatacagcaatggagagtttgcggggtgcctcctacaatatgaactcagtagctgattctccggctctcgtccagaaactctaaattcagagctcaattacttaacttgtacttctgtatcagaagtgataccatttacctagtggaaaagaattatcctctaagtcttaatagttagtcttgatctcaaaactcaggatgaaattggaaaatgttaaaatatcatcagttctttcattaaaaatgtcatttctaagttacacaacaagcaaaggaaatatagtagagactctgttactcatttagggtttcaggccatcctcaaaaaatctcttctttagattagatggtggtgaaatgtcagatttgtttacttaaacattagtgctcccttattcaaagcctatcctttctccagaggtttccatttactgttcccattaccacctgccatgggtgttatttactatttatgggcacctccagatgagtctacaagaggaagaaacagatcagaaatgagaaagagacctgctgatttgctgtgtctctattatatgatacttattatgattttgcaggagtagacattttaactatgagagtcgtgggtttatttgtgagtacgcttcattcatattctctttatcccaaacagtcaccaatactggttatgttgctgtccagtgaataagataaaatatggaatgatctctttctctgaatgggaacacatgttcctccaatctgctttgtgacttaatcagtgtcattatgattgaggcagaagataccatgaatcagtcagaaagaagagtcttataatacacgtctcacttcccaattgagcattcagctgtagataatgttcctgctggagcatttagtgtcttatgagattccttattgagaggacattctcagactcaaacacgggcttgtaaattctgacctatgcaccacgtaaacaatgcaaatagatttcctatcttccctgggccactgttgtactagattacagtttaggtttcataggtccaggctgtgggttctgcgatgtttgcttctttcctgcttcgcagtagtcaactccctggtggttcagcctcttgaaagaagcttgagagtaagcttccttctgcctcaacaggactgaaaaaccactcaaaatccttccaaaggtgaagcattagcatcccataaaaggctgggtcccaaacattgttactatagtatcttctgtcaggattcagaggcatttaatgagttagagaaatagatgaaataaatcaaaggactaccttcccaactacaataattagtggaaattctaatattaggaacttttaccattgaggaatttaagaatttaaggcaattataggttgaatagccaaagtcaggtatgagcctatgagagctcttatagaaatgtcttcattcagtagaataaagacaacattagagaatacaatagcacttttcacttctaaaattgctatccatgtgcctggtatgcttgctttcatttgcaattcaagctcaatagtagaatgttgaggccttctctccacagtttgagaaaaaaagagttgtgaatttgttttgctttttttgttacagatagtatgagtactaagaaactatattttctctgtctggttcttcatgccaaaaaaacaattatctttccaatttaagagtcctccctctcagttcccactgtattcacaaagtgatagagcaatttaggtggttaggattgggagagaaaggagaagaaaagctatggggaaacttcttaaatcaactgactgtggctgagattatctttctttcccactctataaggttataaagccttcctgctgttcaaaataacattgtgccaagacaaatctttctttcccatgtttggcttcttccatcctaatagatggaagggcacaattctaaggtctcagtaggctagccctcaatcttctttatctctctcaagacttcattgattttgttgtttatttatataaatttatggggtagaagtttaattttgttacatagatatactgactagggggaatcactgcttttaatgtatttatcacctaaataatatatattatactcataagtaatatcttatcctccccaaaggcttcattgcaatgagctccatttctctcttttgtctaatttacttcctttttgtttctccaacctccaaaagtctagtcttttttttaaaaaagttatccccagtagagattagagatgactagaagttcttcatgttgtgtaaaggatataaaaattttatgtagaagggactcaaaattggataagactgccctcttcaaaacatttaaaacttctgagtcctcttctagatgttagaacaagaaaattggggtcaataaaggttttctgttcaaagtttcatgcatttttttcttaaggagagaatgtctgtaatgtatcacatttccagaaaaatctatgacacagaaaaggttaaagcagtgcttgagcaaccttgcatcatgagctatttgggtcggctttatgggaatcatcaaaaccctgtgctggattaaattctacagtacatcaggcatttattctttcagctcaagtaacagcattaactgctggagaaagtacctgagaaaacttatggttgggtaaggaacactgagagtcaggatgcatggcctgtgacagacattctgttcttaacttgatggatgaagttgcagcaggatgagccacagactagaacccctcagacaacaatttgtagaaggaaagggctttattcacctgggagcatcggcagactcacgtctccaaaaaccgagctccccgagtgagcaattcttgtcccttttaaaggcttacaactctaagggtgtccatgtgagagggtcgtgatcgattgagcaagcaagcaggcagtacgtgactgggggctgcatgcacctgcaccggtaattagaatggaagagaacaggacagggatttccacagtgcttttccatacaatgtctataatctatagataacgtaacccattaggtcaggggtcagtctttaactaccaggccccagggtgtggcgccgggctgtctgcctgtggatttcatttctgccttttagtttttacttattctttctttggaggcagaaattgggcataagacaatatgaggggtggtctccctctttattcccctccctttgagaacctcactcattagtgggagttttcacttttatttttactacctatgtctttttgcaagacagatcgatagtaattcatacagtacacttgtgccaaagcatttttgtgaactaaggtagcagtgaagctttttatcatttgaagaagtacaggtagtaaacaaggaagcaataagcaggttcttattactattataactcttattataaaagttttaaattctcctagcgctgggagccattttttaaacatggccttaggattaaatccatgccacacttgcacaggcacatgtgtcagttttgtcatatttttaactatgtcttcaactacttgtccttgatcatctatgtgtagacagcaattagtaaggttaaatttcctacagacccctccttcagctgctagcaagtagtagagagctaatctattttgatagatagtatttctcatctgagtttcttgccagagcagaatagtcaaggctctgccggttttattagtgattatttctaagacagcttgtaaccgtatgatttgattgatcctgtaaatgggagtctggtatccccacgagctgtcttgtgtctaagtagcaggcctatgatattgtatgattttttttcagggggctattttttttttaattttttataactatgcttctctttttgtgggaagcatagacagggaagctaggagtttgcctgtttttatgggcagtaggaagaaagatggtttaagagtgccaataacacaactacctgcccactggtcaggtaatttcgcataagctctatgcccacatatccagtataatccagtgggggctgtccagtcctggtgggactccaggtaggtccacacggtttgcaactttgggaatttactaaatggattcctttttgtgtgatttgaactccacccagtgactgttttcgtgttaccactatacagtttctgtcctagacaactaagtcatcctacagggtgagtggattttttttttctagctatgcaatactgtccaataattgaggcttttaggactagaaattgtcagggtgatttttctgagccgggaattcatcaggaactgggtctgtaggtactaattttcatgcttcctatggctgttgatctcctgttacagtttctccacatacataacatgaagtgacattgagaaactgggctacatgctcggctaattgcaaaaacaaatttcttgggttttttttggaatttctggtactggcacatttagttcatcatagaaagtttaaaacactggctcaggagagcgtttgtaaacttttcctgaaactaagatatttactcaaggatccagtctggccccatcgattcctaaggtcacacgttcccctttttttcactgaggatcaaggggattggttattactagctctaaggagttacattgtcccttagtacaggaagggccatttttttcttttttgaaggtggactggatcatttttattttttattcaaatggcctaaatgacacaagaccagtatttacatttatatttatatagtcctaatttatgacaaatttacttacttttggtcatatagtcttttttttaattaagagagtcacatttcctttctaacttattgctattaatgacagcacaggcatcaaatttcaagattatgcatttgggcaccccctttcttttgttctggctaatactttacttgtattatttatgagtcctcaccagtctttagttcttaatcttattttaaaaactgtggacatgggaggcccagaggggtcataacacacatctggctggtcgtttcctgggctacataccttgtactgagtgtcattatataaacatgctccttttaaagtttctaggcattcatagtaactatagaacagaaagattgttttactttcttgtcttacctcagtaacctgatgtatacactaagagtagtctttcatgcggggaaaatcagtggaagtttttactatacaagtccaaattataaggaaaatgagttttacgatgattctcctcatgcttcagccgtgcgtagaccagtcagcttctggatgtgactggagcagggcttgtcgtcctcctcagagtcactttgcagggcttgtccaggctcggttttgtctcctagttttcagtggctgtaggtttcacatggctgttgtggatccaggctgggattccttctacctttacagccgtgggggtggtcaggatgatggtttgaggtcctttccacggtggctgtaaaggggctacgttccagtccttgatccacacgcgatcacctggaaagaaaggatgaactggggagaataagctgatgggacacctcttatttacctaagttgagattgtttgtgtaatttttcttaaagcctgtagctgtcactgtaattcaatttcacctaactctcggggagtgcctggaagtctctgtagtataggaggaggcctatgatacagtatttcataaggggagtattctgttttcttagaaggagtgcatttaattttaaacaataccataggaagggcctgtatctattttaatcctgttttctgacatacttttttaaaactatttttgatagtccgattcattcactccacctttccggaactctgaggtcggtaggcggcatgtagcttccaagtgattcctaatgcctttgctgttttctgtaccaagtcgctcacaaacctgttacctgagccgattcgtaagggcagtctaaacctaggaataagatctcagagaagcacacgggttacttcataggcctttttagtttgtgttggatcagcctccacctacctagagtaagtacacacaagaaccagcaaatacttgttacctccacattttggcatttctgtgaaatttacctgaagatcctcaaaaggagctgctccataagcttgtgtgccaggtggaacagtggggctttgcctcacattgtgctgttggcaagtaacgcactgttgtgctactgctttggcaagggctggcaaatgtgagatgtagaagtactggcctaacaactttttaagtgactcttgaccttagatgagtagttttgtgcacggccaatacgattgtggctcccagaaactgtggcacagctaccttcctatctggcagtctgatctatcctccttttattacttgccccctttctgcatggaaaaagtctttttcttccttagaataggtaggtaccaggtcaggtgtttgagggagtaatggggctgctaccgatgcccagtaaggggtagatgctgcttttcgagcttctgaattagctcgagagtttcctagggccactgaggtggaggctcgctggtgtcccctgtagtgcatgactgccaccttttgaggtttttacactgcctctaataattgtagaatttcttgttgatattttatgtcctttcccccagggtttaacaggccctttttcttgtataatgctccatgcacttgagaattagaaaggcatatcgagagtcagtgtagatgtttacagtcttacttttactgagttctagaatctgagttaaagcaatgagctcagccttctgggctgaagtgccctgtggcaatggtttggcttcaatgacagcatccaaagttaccaccacatatcctgcacatctttcatcttgtgggttgatgaagctgctcccatctacatataactcccagtctactgagatgcccatggctggtcctgaaggtcaggtctgctagaatagactgagcccaacacctctacacagttatgctcaaccagcctttctgataatgggaacagggtggtgggatttaggttgttacagacttcaattgttatctggggattttcacaaagcaagctttggtacttggttaatttagcatttgttagccaatgatgtcctttggtattcatcaaggttaccacagcatggggggcttttatattcagcttttgcccaagggttagtttatctgcttcttgtgctaacagggccgttgctgccagggcccttagacatggtggccggcctttggaaaccccatctagttgttttgagagataggccactggtcttggccagggccccacagtcggttaaaactgtaactgccattttttttctttttgacacatagagtgtaaagggctttgtcaaatctggtagtcctagggcacaggccaacgtaagtttttcctttaacttacaaaagactagctcttgtagaggctcccatttaaaagttaccggtcgcccccctttgtagccccgtacaaaggttgggctagtactgcaaagtttggaatccataatctgtaaaaccttacagctcgtaggaattcccttacttgccttctggttttaggttccagtaggctgcagatgacctgctttcttcctgactccaggctgcgctcccctttccgaatagtgaatcccaggtagcatacctgctgtctgcagatctgagctttcttcttggacactttctacctacagtcctccaggtgctgaagtaggacatccgtactttttgcgcacccgactgccaaggagtgtcccagcagaaggtcgttcatgtacaaaagcaagatgcagcctaggtctttagcaggaaacttttgcaggtcttgagccagggcctccctgaagatagtaggggagttcttgaacccttggggaagccgggtccaagtgtactgagtagtcacacctgactccggatcttcctactgaaaggcaaacagcttctggctctcaggagctagtctgatgctaaagaaggcatcttttaagtccagacaggtaaaccaactgtccttagcaggcagtagccctaacaatgtgtaacggttaggaactgttgggtgcagagtcactgtagcttggctgaccaagcgcaagtcctgcactggccggtagtcctttgtccctggcttagggacaggcaggaggtaggtgttctatggagactggcaaggaactatagttctaaattataggtgcttttaagcgcctgagatgaacctggattccctcaagagcttctctgggaaccggatactgcttttgtctaattggctgggccccaggcttaacttctgtgagtacgggtgcttgattgactgccagtcccagaggattatcctctgcccatatttggggccatcgcttagctagactggttttatctcttggcctggctcggttagaaaaagtctctattctttttcctgggggaccgtaagggccatgataactcctgttcccagtaactttagctgtaaagagccctgtcttgtaaaggagatggtggctctcagcttgctaagcaagtctcttcccagcaaaggcaagggacagtcaggcatgtacaagaactggtgaactattttatgtcccaccacccagcaggtccgtggtagacagaaagcctgcttagtggaaacttctgttgctccgattatatcaatggttttctcgggtaagggggtgaccggggtggtcactactgaatgttcagcaccagtattgaccaaaaacttaatgtccttgcctccaattgtaatcctgacggcaggctccttgggggcgcttcagcccagtccccttcagtctaatagcccttcagccagattgaacaaagctctctcatctttatctaaggtcttttgttctgaatcaccttgtttttccttcagttggggacacttatttttctaatgtcctatttccttacaataggagcattggttacattgaaagtgtgggcgattagactgggtattcttcccagaaccctccttttctttcccttttgggggaattcccttaatggccgcggccagtaagttggcgtttccgcctggcctggtgttcggctttctcagcggcttgttgcatctttgttcacaaacaaacacttgattggctatttccagtaatggcgaggtattcatacccacaaaccctgcctgtttttgcaattttttcctgttatcttctgtgctttgactaactaaggccatgttaatcatgtgctgattttcagggctatttggatcaaaaggagtgtacatacggtaagcctcacacagtctttcatagaattgtgctggactctcccctttttcttggatgacctcagagaccttatttaaatttgtaaccttttgagcccctttctttagaccttttatcaatgccttaggataccatcttagcctccctgtgtctggtccctcgttcaggtcccattgggggtctgttccttgcagctgaatccttatatattcttgggggttttggtaatcggctgggacatgctactctagctacttagttgccgcctggagcaccctttgccttttatttgtattaaagaggtacatgagcagctggtggcaatcagcctaagtaggattatgagtctgtataacggtttggagcaagtcaattaaagcttgaggctttttggtataaggtggagtattatttttccaattgaggaggtcagcagaggtgaaaggttgatacaaaggcacgcctttccaccatgtgtccatcctcatttaccccagtaatattgctgttctctcaggggcatttggattccagtcttaggccgtaagcaagctgccaagggaggagtttctccttcagctttacttcctcttttgtctatgctgggtggtctaggagtgtggctatctggtggaggtggaggtgctgtgggttctggagtggggagcccttcctctcaataaggagggggtattcctggtaccaattcctgccatgattcttctggtgttgggacagacaggacttttggtgctgaattccctcggtgggtggagcgagaaccttccttaactaactgtccctttgctactagtactgctgctgcctgtcctcttaaccactgtgaggggtctaaaactaactgtaaccaagaatctatatgtatatacgggaattgatacgggaattgatctgggtgccctggcttacaagttaccttgtgccacacttttgagagaagggacctgtccaggcttccttctgatggccaacgtacctgtaatgctggccagtctatctcacacaaagttctaagttttcttggtgtcataactccatagtctcccttaaatcctgttttgaaatttttcaacatagttcctagtgggatgggctcactttgtgcctcacccatgtttcctccagacaaaacaccacactcacaccacactcacaccacaaaacaaagaacaggtaaagagggcacacacacacttttacagtttacaccaaaccagaaacaaccaaaatcagagtatcaaatccaagccaggtcaaaaccaaaaccaaagtatcaagcaatccaagtcaagccaaaaacaaaaaccaaagtgccagtacaggcacgtcgtgggtgatcaggccatgcttccactcaaatggagtgggcaagttccaaagaccagtcttaccaagtttcagatgtccggactccaagtgccagttccttcccggtgttcagccactgcactgatcatccacaagggcctgctgtccaccgctctgacgaggcgttccaccagggcaaatgcctacccgagagtgctctcaggatctgcatcgctcaagctggccggagtcccccgcagggatgctccacagggcaggcctaagctgactaaggggctgactcaactgtccgtccttaatcacctgcttcctggtcaggaaaccacgaaatgtagcaggatgagctgcagacaagaaccgctcagacaccgaattgtagaaggaaagagctttattcaactgggagcatctgcagactcacatctccaaaaaccgagctccccgagtgagcaattactgtcccttttaagggcttacaactctaagggtgtccatgtgagagggtcgggattgattgagcaagcagggagtatgtgactgggggctgcatgcacctgcacgggtaatcagaatggaacagaacaggacagggattttcacagtgcttttccatacaatgtctgtaatctatagataatataaccgattaggtcaggggtcgatctttaactaccaggccccagggtgtggcaccgggttgtctgcctgtggatttcatttctgcctttcagtttttactttttctttctttggaggcagaaattgggcataagacaatatgaggggtggtctcccccccttaaagtgagcaaataatctcatctccctgggcaatagtgtttctaaacactgtttctaaagtgagagagttggactaattcaatggtttcacatctaacctggagacttttggaaaactctggatcactgggttccatccaccaccagctataagagactcactgtagttagcacaatggattttttttaaagaaagctactcaagacattctgttctttgacaagtagagaaatcatttcagcagacagtctgtggtcacttctagctttaaaatgctgagtttccaataaaaaaaatactctgggcagaatctggattggtatgaagtgttaatcatctgaataaatatagtgctcttttttaagcataagtgattaatactacatgtaaatgaaattattcagatagcccatcagattgctgggaagttactaattatatacatatatatatgtgtgagtgtgtgtgtgaatggagtacacttgattatgcctcacgcttttaaaaaaatgttcagcctttattttagatagatggggtacatgggcaggtttattacatggggatattgcaccaaggtagtgagcatagtacccaacaagtagattttcaacccaggcccccttccccgctctctctagcagtccccagtgtttattattcctatgtttatgtacatgtgtactcattgtttagctaccatttgtaaatgagaacatgtggtatttagttttctgtcccccattagtttgctgaggattcttgcctccagattcatccatgttgctgtgaaagacatgatttcattctattttatgactgtattactatggtaatttatcactgtggtggatatgtaccacattttctttatccaatccaccactgacggtcacctatgctgattctatgtctttgctatagtgagtagtgcagcaatgaacatatgagtgagcatttctttttgatgtagtgatctattttcctttgggtatgcgcccagtaatggaattgctgggtcaaataatagttcttcgttttttgcgaaatctccaaactgctttttgcagtggccgacctaatttacattcccagcaacagcttttccttttctccacagctttgccagcatctgttttttgactttttaataacagccattctgactagtgtgaaatggtatctcattgtgattttgatttgcatttctctgatgattagtgatgatagctttttttcatatgtttgttggccacttgtgtgtcttcttttgagaggaatctgttcatgtcttttgctcactttttaatggagttgtttggtttttgcttgtaaatttgtttaagtttcttatagattctggataatcagacctttttcagatgtatagttcataaatattttatcccattttgtcagttgtctgtttactctcttgatagtttcttttgttatgcagaagctctttagtttaattagatcggacttgtcattttttgttttcactgcaattgcttttggggacttggcaaaaaattctttgccaacactaatgtcaagaagagtacttcctaggttttcgtctaagatatttataattttaggtcttatacttctatctttcatccatcttgagttaatttttgtatgtggtgacagataggagtctagtttcattcttatgcatatggctatccagttatcccagcaccgtttattgaacaggaagtcctttcccattacttatgtttgtcgatcttatggaaggtgagaggttttaaacatgtggcttcatttctgagttttctattctgttccattggtctgtgtgtctgtttttgtaacagtaccatgctgtttggtcattatagccttatggtgtagttacaagtcaggtagtgtgatgcctccagcttcatttttgttgttgttgttgcttagaattgcttttgctgtttgggctctttttttggttccatatgaattttaaaatagtttcttctcattttttgaagaatgatattggtagttcaataggagtagcactgaatctgtaagttgctttggccagcatggtcattttcatgacactgattcttctagtccttgagcatggaatgttttttcgtgtgtgtgtgtgtgtgtgtgtgtgtgtgtgtgtgtgtgtgtgtgtgtgtgtgtgatttctgacttctttcacaagactttcgtaattttccatgtagagatcctccacctctttgattagctgtttttctaggtacttcattttctttgtgactattgtaaatgagattgtgttcttgatttgactttcagcctggacattattggtgtatagaaatgctattgatttttgtacattgatttttgtatcctaaaaccttactaaaattgtttatcagttctagtagcctcttggcagagtctttaggggtttctagatatacaataatatcacaaagagagacagtttggcctcttgtcttcctatttggatgccttttgtttctttctcttgcttaacttctggctaggactttcagtactatgttgaacaggaacggggagagtgggcatcttacatggttaggctttgtgtccccacccaaatctcatcttaaattgtaatccccaggtgttcatggggagaactggtgggaagtgattggattatggggcagttttctccatgctgctctcgtgatagtgagtgaattagatctgattgttttataaatggcagtttttcctgtgctctcacacacttgcttctctctcatccctgccaccatgcaagatgtgcctgcttccccttctgccatgattgtaggttttctgaggcctccccagccaagcagaactgtgagtcaattataccccttttctttataaattacccagtcttaggtagtatctttatagcagtgagaaaattggcaaatacagcatctttctcttgttccagttttcaaggggaagggttttttagcttttgctcattccatatgatattggctgtggctttattattgatgagtcttattattattattatttttcctgccctacacaacattattctccttatgtcatttatattacaaattacattagtacatgatgaaccattaatatagattgttttattataacttttattttaggttcaggggtacatgtgcaggtttgctatatgcataaactgtgtctcccacagttttggtatgtagattatttcatcagccatgtactaagcctagtatccaatagatattttttctgatgctttgcctactctcactcttcaccctcaagtaggccccagtgtctgttgttctctttgttttcattgtttagtgccacttataagtgagaacatgcagtatgtgattttctgttcgtgtgttagtttgcttaggataattgcctccagctccacccacgttgctgcaaagggcaggagctcattctcttttgtggctgcatagtattccacagtgtacatgtaccacatttactttatccagtgataggtatccccacacaaatctcgtcttgtagctcccataattcccatgtgttggtgggagggacccagtgagagatgattgaatcatgggagtgggcctttcccttgctgttctcatgatggtaaatgggtctcatgatggccaatgattttgaaaacaggagtttccctacacaagctctctctttgcctgctgtcatccatataagatgtgacttgctcctccttgccttctgccatgattgtgagtcctcttcagccatgtggaactgtaggtccaataaacctctttcttttgtaaattgcctagtcttgggtatatctttatcaacagcatgaaaatgaactaatacattcagtcttctatttatggccatttaggttgactccatgtctttgctattgtgaacagtgctgcagtgaacatatgcatccatgtgtctttatggtaaaataatgtatattcctttggctatatacctggtaatgggattgctggatcaaatggtagttctgtttttaggtctttgaggagtcaccgcacttctttccataatagttgaactaatttatactcttaccaacagtatataagtgttccttttcccccgtaaccttgctagcatttatttttcaacttttaataatggccattctgactgctgtgaaatactatttcattgtggatttgatttgcatttctctaatggttagtgatgatgagcattttttcatatgttttctagccacttgtatgtattcttctgaaaagtggctgttcctatcctttgcccacttttttatggggttgtttcgtctttgcttgtaaatttgtgtaagttccttatagattctggatattagacctttgttggatgcatagtttgcaaatattttctcccattccgtaggttgtcttttcactctgctgataatttcttttgctataagctccatactttaattagttcccatttgtcaatttttgcctttgttgcaattgcttttggcatctttttcgtgaaatctttgccaggtcctatgtccagaatggtattgcctaggttgtcttccagagtttttatacttttgggtttcacatttaagtcttgaattcatcttgagttaacttttgtttatggtataaggaaagggtccagtatcaatcttcttcatatggctagccagctatcccagcaccatttacaccacttattgaggagggagtcctttccccattgctggtttttgttggctttgttgaagatcagatagttgtaggtgtgcagccttatttctgagatctctattctgttccattggtctatatgtctggttttgtacaaggaccctgctattttggttactgtagccttgtaatatagcttgaagtcaggtaacatgatacctcagctttgtctttttgcttaggattgcctttgctattcaggctcttttttagttttgtacaaatttaaatttttttttttttaaattgcatgaagaatgtcactggcagtttcataggcatagcatctgtaaattactctatgcagtgtggccattttaatgacattgattcttcctaatcatgagcatggagtgtttttccatgtgtttgtgtcatctatgatttccttgagcggtgttttataattctcattgtagagatctttcaccactctggttagctgtattcctcagtattttaccctttttgtggcaattgcaaatgagattacattcttgatttggctcttagattggatattgttcgtatacaggaaggctactgattttctacattgattttgtacctgaaactttgctgaaattgtttatcagatcacagagcttttgggcagagactatggggttttctagatataaaattatattgtctgcacacagggatattttgactttctctcttatttggatgccttttatttctttctcttgccttagtaccctggccaagacttccagtactatgttgaataggagtcatgatagagggcatccctgtcttgctctggttttcaacagaatgcttctagcttttgcccatttagtattatgttggctgtggatttgttatagatggctcttattattttaaagtatattccttcaatgactagtttattgaaggtttttaacatgaagtgatgttgaattttatcaaaagacttttctgcatctattgagataatcatgggttttttatttcagttctctttacgtgatgaatcatatttatttatttgtgtatgttgaaccaactttgcatcccagggataaagcctacttgatcttggtgaattacctttatgatgtgctgctggattcagtttgctagtattttgttgaggatttttgtctgtgttcatcaaggatattgacctgaagttttctttttttgttgtgtctctgccaggttttggtatcaggatgatactggcctcataaaatgagttaggaaggagtctatcctcctcaaatttttgaaatagtttcaataggaatgatatcagcttttctttatacatctggcagaatttggctgtgaatccgtctacttctccacctgtttttggttggttggctttttattactgtttcaattttggaactcattattggtctgttcagggatttaatttcctcctggttcagttttaggaggttatatgtgtccaggaatttatcaggttcttctagattttctagtttgtgtgcatagaggtatatgtgtccaggaatttatcagtttcttctagattttctagtttgtgtgcatagaggtgtttgtagtagtctctgagggttttttatattcctgtaggtcagtggtaacatcccctttgttatttctaattgtgtttatttggctcttctctcttctttcctttgttagtctagctaatggtctgtcgtattaattttttaaaaaccaactcttggattaattgatcttttgtatgatttttcatgtcttaatatccttcagtttagctctaattttggttatttcttatctcctgctatctttggggttggtttgctcttgcttctctagttcctctagttgtgatgttaggttgttaatctgagatatttttaactttttgatgtgggtgtttagtgccataaacttcctcttaacaccgccttagctgtgtcccaaagattctggtatgttgtgtctttgttcttattagtttcaaataactttttgatttctgccttagtttatttacgtaaaactcactcaggagcaggttgtttaatttccatgtaactgtatggttttgagagattttcttaatgttgatttctgtttttatgcactgtggtccaagagtgtggttggtatgatttcaatttctttgaatttgctgagggttattttatgtctgattttgtggttgattttagaatatgtgccatgtggcaatcagaaggatgtatattctgttgttttgggtggagagttttgtagatacttgacagatccatttattcaagtattgaattcaggtcttcaatatcttcgttaattttctgcctgaacaatttgtctaatactctcaatggggtattgaagtctcccactactattatgtgggaatcaaagtctctgtgtaggtctccaaaaacttctttatgaatctgggtgctcctcccttgaaggcatatatatttaggatagttaggtcttcttgttgaattaaactctttaccattatgtaatgtcctactctatcttttttggtctttgttggtttaaagtctgttttgtctgaaattatgacagcaaccactgccttttcctgttttccatttgcttggtagatttttctttatccctctattttgagcctgtgattgtcactgcttgtgagatgcatctcttgaagatggcataccagggtgtattgcttctttctccgtgttgccactctgttacttttaaatggagcatttagcgcatttacattccaagttaacatttatatgtgtggatttgatccttttatgttgttagctggctattatatagatttctttgtatggctgctttatagtgtcactggtctgtgtacttaagtgtgtttttgtagtggctggtatgtttgtttgtttgtttttctttccatgtttagtgctccttgcaggacctcttgtaaggcaggcatggtggtaatgaattccctcagcgctgacttgtctcaaaaggatcttatttctcctccacttatgaagcttagtttggctggatataaaattcttggtggaaaattattttctttgatcgtctgaagccttcttctctcaactcgtcaaagtcattctccatccagctttcttctgttgctggtgaggaactgcgttcctttggaggacgagaggtgctctgctttttagagtttccagtttttctgctctgttttttccccatctttgtggttttatctacttttggtctttgatgatggtgatgtacagatgggttttttggtgtggatgtcctttctgtttgttagttttccttctaacagacaggaccctcagctgcaggtctgctggagtacccggccgtatgaggtgtcagtctgcccctgttggggggtgcctcccagttaggctgcttgggggtcaggggtcagggacccacttgaggaggcagtctgcccgttctcagatctccagctgcgtgctgggagaaccactgctctcttcaaacctcagatggctatgggaggacattcaaatcaaaggaaaagaagttgagaactttgaaaaaaatttagaagaatgtataactagaataaccaatacagagaagtgcttaaaggagctgatggagctgaaaaccaaggctcgagaactacgtgaggaatgcagaagcctcaggagccaatgcgatcaactggaagaaagggtatcagcgatagaagatgaaatgaatgaaatgaagcgagaagggaagtttagagaaaaaagaataaaaagaaacgagcaaagcctccaagaaatatgggactctgtgaaaagaccaaatctacgtctgattgatgtacctgaaagtcacaaggagaatggaaccaagttggaaaacactctgcaggatattatccaggagaacttccccaatctagcaaggcaggccaacattcagattcaggaaatacagagaacaccacaaagatactccttgagaagagcaactccaagacacataattgtcagattcaccaaagttgaaatgaaggaaaaaatgttaagggcagccagacagaaaggtcgggttaccctcaaagggtaacagcagactaacagcagatctctcggcagaaactctacaggccagaagagagtgggggccaatattcaacattcttaaggaaaagaattttcaacccagaatttcatatccagccaaactaagcttcataagtgaaggataaataaaatcctttacagacaagcaaatgctcagagatttttgtcaccaccaggcctgccctaaaagagctcctgaaggaagcgctaaacatggaaagaaacaaccggtaccagccgctgcaaaatcatgccaaaaagtaaagaccatcaagactaggaagaaactgcatcaactaacgagcaaaataaccagctaacatcataatgacaggatcaaattcacacataacaatattaactttaaatgtaaatggactaaatgctccaattaaaagacacagactggcaaattggatgaagagtcaagacccatcagtgtgctgtattcaggaaacccatctcacaggcagagacacacataggctcaaattaaaggacggaggaagatctactaagcaaatggaaaacaaaaaaaggcaggggttgcaatcctagtctctgataaaacagactttaaaccaacaaagatcaaaagagacaaagaacgccattacttaatggtaaagggatcaattcaacaagagctaactatcctaaatatatatgcacccaatacaagagcacccagaatcataaagcaagtcctgagtgacctacaaagagacttagactcccacacagtaataatgggagactttaacaccccactgtcaacattagacagatcaatgagacagaaaatcaacaaggatacccaggaattgaactcagctctgcaccaagcggacctaatagacatctacagaactctccaccccaaatcaacagaatatacatttttttcagcaccacacctattccaaaattgaccacgtacttggaagtaaagctttcctcagcaaatgtaaaagaacagaaattataacaaactatctctcagaccatagtgcaatcaaactagaattcaggattaagaatctcactcaaaaccgctcaactacatggaactgaacaacctgctcctcaatgactactgggtacataacgaaatgaagacacaaataaagatgttctttgaaaccaacgagaacaaagacacaacataccagaatctctgggacacattcaaagttgtgtgtagagggaaatttatagcactaaatgcccacaagagaaagcaggaaagatccaaaattgacaccctaacatgacaattaaaagatctagaaaagagcaaacacattcaaaagctagcagaaggcaagaaataactaagatcagagcagaactgaaggaaatagagacacaaaaaacccttcaaaaatttaacaaatccaggagctggttttttgaaaggatcaacaaaattgacagaccactagcaagactaataaagaaaaaaagagagaagaatcaaatagacacaataaaaaatgataaaggggatatcaccaccgatcccacagaaatacaaactaccatcagagaatactacaaacacctctatgcaaataaactgcaaaatctagaaaaaatggataaattcctcgacacatacactctcccaagactaaaccaggaagaagttgaatctctgaatagaccaataacaggagctgaaattgtggcaataatcaatagcttaccaacgaaaaagagtccagaccagatggattcacagccgaattctaccagaggtgcaaggaggaactggtaccattccttctgaaactattccaatcaacagaaaaagagggaatcctccctaactcattttatgaggccagcatcatcctgataccaaagccgggcagagacacaaccaaaaaagagaattttagaccaatatccctgattaacactgatgcaaaaatcctcaataaaatactggcaaaccgaatccagcagcacatcaaaaacgttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcccttgacaaaattcaacaaccttcatgctaaaaactctcaataaattaggtattgatgtgacgtatctcaaaataataagagctatctatgacaaacccacagccaatatcatactgaatgggcaaaaactggaagcattccctttgaaaactggcacaagacagggatgccctctctcaccactcctattcaatatagtgttggaagttctggccagggcaattaggagaaggaaataaagggtattcaattaggaaaagaggaagtcaaattgtctctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaagggcctcttcaaggagaactacaaaccactgctcaatgaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccgaaaaagagcccgcatcgccaagtcaatcctgagccaaaagaacaaagctggaggcatcacactacctgacttcaaactatactacaaggctacagtaaccaaaatagcatgatactggtaccaaaacagagatagatatagatcaatggaacagaacagagccctcagaaataacgccacatatctacaactatctgatctttgacaaacctcagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaactaaactaaagagcttctgcacagcaaaagaaactaccatcagagtgaacaggcaacctacaaaatgggagaaaattttcgcaacgtactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgcaacctagttcaaccattgtggaagtcagtgtggcgattcctcaggggtctagaactagaaataccatttgacccagccatcccattactggatatatacccaaaggactataaatcatgctgctataaagacacatgcacacgtatgtttattgcagcattatccacaatagcaaagacttggaaccaacccaaatatccaccaatgatagactggattaagaaaatgtggcacatatacaccatggaatactatgcagccataaaaaatgatgagttcacgtcctttgtagggacatggattaaattggaaatcatcattctcagtaaactatctcaagaacaaaaaaccaaacaccgcatattctcactcataggtgggaattgaacaatgagaacacatggacacaggaaggggaacatcacactctggggactattgtggggtagggggaggggggagggatagcattaggagatatacctaatgctagatgacgagttagtgggtgcagcgcaccagcatggcacacgtatacatatgtaactaacctgcacattgtgcacaggtaccctaaaacttaaagtataataataataataataataaagaaaattactttctttaagaatgctgggatactgtacaaaaagagacacataagtcaatggaacagaattgagagtccagaaataaggccacacatctacaaccatctgatcttcaacaaagctgacaaaaaccagcaatggggaaaggactccttattcaataaatagttctgggataactggctagccatatgcagaagattggaactggacccctttctttcaccatatataaaagtcaactcaagatggattaaagacatgtaaaacccacaagtgtaaaaaccctggaagacaaccttggcaaataccattctggacataggacctggcaaagatttcatgacaaagatgctgaaagcaattgcaacaaaagcaaaaattaatgagtgggatctaattaaagtaaaaagcttctgcacaacaaaagacactatcaacaaacagcctacagagtggtagaaaatttttgcaaaccttgcatctaacaaaggtctaatattcagcatccataaagaacttaaacacatttacaagcaaaacacaaacaactccactaaaaagtgggtaaaggccatgaacagacacttttcaaaaaaagacctacaagtggccaacagtcatatgaaaaaaagctcaatatcactgatcattagagaaatgcaaatcaaaaccatgagataccatctcacaccagttagaatgtctattattaaaaagtcagaaaataacagatgctggaaagattgcagagaaaaaggaagaatgcactgttggtgggagtgtaaattagttcaactgttgtggaaagcagtgtgtcaattcctcaaagagctaaaaacagaactaccattcaactcaacaatcacattattgggtatatacccaaatgaatatacattgttctaccataaagacacatgcacacatatgttcattacagcactattcacaatagcaaagacatggaatcaatctacaagcccactgataatagactagataaaagaaaatgtgagatatatatatatatatacacatatatatatctctctcacattcatataatatatatgtatgtgtatatatatacactatatatatacacacacaatctctatatatgtatatatagatacacacacacacacacacaccatggaatactacaccgctgtaaaagagaatgagatcatgttctctaaatgaacatggatggagctggaggccattatcctaagcaaactaatgtaggaacagaaaaccaaatgccacattttctcacttataagtgggaactaaatgatgaaaacacatggacaccaagaggggaacaacagatactgagacctaccagagggtgaagggttggaggagggagaggatcagaaaatataataggtactaggcttagtacatggggaatgaaataatctgtacatcaaacccccgtgacacaagtttacctacataataaacgtgcacatgtacccctgaacttaagataaagttttttttaaaaaagaatgttgatataggcccacaatttctcctggcttgtcgagtttctactgaaaggtctgctgttaacctcatggggttccctttgtaggtgacctatcccttctctctagctgcctttaacattttttcttacatttcaaccttggaaaatctgatgattatgtgtcttggggatgtctttctctttagtatttcactggagttctctgcattttctgaacttgaatgttggcctgtctagagaggatgggaaggtttgcatggatgatattctgagatatattttccaggttgcttgctttctccctagctctttcagggaccccagtgattcatagattttggtctgtttacataacctcatatttctcagaggttttgttcattcttttttattcttttttatgtattttctgttttactgagttatttcagtgagccagttttcgaactctgagattctttcctcagcttggtttattctgctcttaataattgaggttgcattgtaaaattcttgtagtgtgtttttcagctatttgcttctgttttataatggctatttcatccatcagctcctgaatcattttatggtactcattagattccttgtactgggtactgactttctcctgaatctcgattgtctatgttcccatccatattctgaattctatttctggcatttcagcgatttcaacccagttaggaacccttgctggggaactagtgtggttgtttggaggaaagaggccactctggctttttgagctcccagagttcttacgctggttctttctcatctgtgtgggctggtgttcctttaactgtggtgtaatttgggtataatcagtaggtttcatttctggatgttttcagagggccaaggctttgtgcagggcctttatttttagctgagctcttgtctttggtttcacagaggagtatattaccaaaagtatttttgctgttgaagtttgtgctgtgattcaataggtggtgcttaagtgaaatggccagtaggtaggcacttgcttgaccatgtggctcctctgtatttcctcatgattgcagctatgctccctctcagtgctctgacagtgtgggctcctctcccacttgagggctggctgcagatctcggtttggctctcctgggctgcacactgcaattctggagtgagctcaggctttatgtggcctccttagcttggagacagcaaggccagggaccttagcagtgactgtgacagagggcctttctctcgtctctgggggctccactccagagaaatgcagagttgctaccaatcagtataatcagccaaggttggggtggctgcactggggacccaagctgggggcaccctacctgataacaagcagggagggtacataggtcacagagtagacagactggcctctttccttagggcaactgcagcttcctagaagtgtggttaaagcactcatggtctttttgccttccccagtccgagggcagcaagagcagtaccactctgcagtggccatgggagtgggccttcaattgtctctgggacctctgcctcagagaaacacagcgcccctgccactggaaatgttcagccaggggatgagacaaacgcactgctggcctgagctgggggccctgcttggtgaagaatggaggttcaagagcttacagggaggagagactgagctcctctctgtatggtggctgtggtgtgcttggagcacaggtgaagcccttagactgtttcttccctatagcaagggcagcaggagcagaaccactgctgtggcaatgacggagaggctgttgattgcctctgggagcccccaccagggaacctcagagccagtatcagtgggtgtgctcagctatgatgaggaggctgatctgtggtccggagccagaagccctgcctcatgaagagtggggggcctgggctcacagggaagagggtctggattcctctccttatggtgtgtagtgtgctgaaggtgccagcatagtgactaggccctttgttccatccccagccccacagcgattagggcagtaccattgcagctgcaatggcagagggattgtgggttttctctgggagttcctgctcagagaactgcagagccacctccaactgacatgttcaggtggggacagggtagttgtgttggagtcccaggtcacaagggcctcccagtaaggagaaacaggatcggagacctgggtggaaaaaggtctggctgctttttccacagggcagctgcattgtgctggggatctgcaccagtcccttgtcaccacgtaccttctggaagcctgaaggcaacagggaggggcaagggctgcaagacagcaaaaatggcggcttgcctctgtgggagcactgtcccaggaaaacacggagctgctaccttcccaaaagatggctcttactattttcgggtatattcctctgatgactaatctgggttattatcatgaagggaagttgattttatttgcatctattgagatgatcattcgggttttgcttttaattctgtttatgtggtgaatcacattttttgaattttgtatgtcaaaccagccttgcatcccaggaataaagcctacttgatcatgctgtatgaactttttgatgtgctgctggattcattttgctagtattttgttgaggatttttatgtctatattcatcagggatattggcctgaagttttctgttttcactgtgtctatgccagattttggtactaggcttattctgcttgactcttgaccgtcagtacatttggtaaaagatgagataaggttaccttaggtaatcaaaggtatcaaaaagtaggaggaagaaaaatatattgcatgccaaacacttaaatatagtattgcatttaaccttaataacagccaatctggtgttcatttctctgcttagtcagttattactttgcagccatcaccaaatcacttaactctaatttggtccttttgtttcctcttctgcagaatagagactaaaaatacctatattataggatcacagtgggaattaatgggcataatgtctgggaaacacttatcagggtgcttatcacatgatggataaataattgataggaaataggatgataataactgtgatgttggtcatgagctcttactactcaaaatgtgtctccagggccagcagcaccagtattacctgggagctaactagaaattaggaatttcaggccccacctcagacctcccatgtcagaatctgcattttaatgagatccctaagtaattcatgtgcacatacatgtttgaaaagcactagtatagaaaaatgactctgggattcagcaacttgacagaactcatctagtggtaaaccacacaactagaagcatactcaaatcagaagatgctaaggccagcatctttctcttatatctctaacggtatctgtgattggaggtgttcagccttcctgaatcccattgtcatgttcttctgtaatccaagctataaatgaaaggctttttacaaacatgttttcatgtctaccacagtagcaagaacaccataattttgttttatttttcacatttttaattattcagctgttttatttgtcaccatttagggaattattacaaaacttatgtctaaaatgcatctggttaaggcatattaaggcggctaagcagatgtagaatcggttgactgctatcataaaattaaacactgatgaaacatatatttgcacagcaataatgatcctggcatttgtataaatataacagatctatttccctaatcatctagggaaaaaaatgaggaaagggtgacagaattaccaaatttgtctggcttactaggcagatcattttcaagtacaaattttttttcatgtgaataaaatcatgttaattaacagcatctattaccacattaaaatgaaagaagtgtatttgagcaaaaaacaatgtagataatatcagaagcatgtttccaggacatgtcataatttccagagcttctttataatcatggtaggtgcatgtttttaagatattcctctatagtgccatagtttgattttatacaaaatgtgtcctgagattcaagcctaagtgaataagatatatatttttccccacattttagtatctctgaaatttaaatctgtcttacaattgatggtatatcaacactgattggcagcagtttttcttctttttttgtgatcagtggaatatttgattcaattaggggattaggattcccagtaaactgaaaccttgtccacagggattaccacagtgagatagtggaaaacaagtggaacagaaaggatagctcatgcctatgagcgttcaggcaaaaagagaagtgaataaatagaagtaatgagattaaataagaaatgatttcatagatttctatttccacagagccagaaagaaaaatcgaggaagatgagcaaatttagcaaaatagcaagaaagaagaatagggagatagaggaaaaaaaaaaggagagagaatgaagcatcaagatggaaaatacagccaataagcccactattgtgatcattattttttaggtgtggtatcctgtggtagacattcaacttggtgctccttttctcattacacacactgatcagtagtggtcctagaggataggatgaggcagttgtttttggcacattgtagaaggtgttttctcttctctggcctgcacaggtagatccacaccccttcctgtgctccttccctcccacaaactctgtacatacttctctttcctctgcctgctgcatttcacccagtcccaaaccaccaggatatgtaaaatgattaatacttctgtttgttctttcaggtgatatcaagactatcaaacaaatctatggtctcacaggtatggcttttgctacacagcaaaatatttatctaaaatctggaggattaccaataaatctgtcttgtctttctcttcagaatttcatgtatttatcttttactttccctacttgacttcccaataagagatgtggcaactgacttgcttgagtttgagtatagaggagaattgaaactcatagttctatgggagcattttatagttattgttataaagcagtttgttaccaaaacatgccaaatgtaaagtcctaaggtgttaatcttaaaagtactttcattgcatttaaaattggcagtcaaattttttcttgtaagtgtccataatgctaaaaatatggttgagagatattctggaaccatgttttatgattcagtcagctcttaaaacagtttcaacttttaagaactctctaattaatttcaagaaaagtttcccgaaaaaactaatttgttaagattattagctggacttttattaccaataatcctgtgacacagaggcacgcaaatagattaaattacctaatgcattatgaagacattaagaatttactgaagatgatggtggagaagggtcaaatagggtttactttttattttaattatactttaagttctgggttacatgtgcagaatgttcagttttgttacataggtatacatgtgccctggtggtttgctgcacccatcaacctgtcacctacattaggtatttctcctaatgttatccctcccctagccccccaccccccacaggcaccagtgtgtgatgttcccctccctgtgtccatgtgttctcattgttcaactcgcatgtatgagtgagaacatgtggtgtttggttttctgattgtgatagtttgtaatgtcggctgccctgattgtgagtcaatatctaagcaacttgtccaagacaccaagtctccatgacaaaatggaagtatgaaatttccacaaacttgtagaagtacaaatacttgacaggttattagagaattcaattagagccaatagaggcttcttgaaacaaaggaatgattaacttgccaatgcaaatgtaaacagaattctaattagagaatgcgctcattgtttctcatttcttagattaagtttgccctgttgtgtctttagctgggtaaactgatttttctatccaacgatgctagtatacaaatgttcccctgtaattccgtgtaggcccaatttttgttaaaaacacagagttttaaacgctgtgaaaaacaaacaagagtaacatcatgactatcccagcaaaaaaaaagtatgccctcgtcattaattaaaataaccatacgtatttggaaagatgagtctaagaatgccatttcttcaagaaattttgagccaataagattaaagtacaagaacttcataagtaaactatgcatttcactcagcacctatggcctaaactgaacgggctattgcctataagtcactgcaatgttagatctgttattatacctgtaatatatacaccatatacaccaaaaaatccgtatacaccaaaatccatatacaccaaaaaaaacaactattcatttaagtcaataaccatgacagcccagagtctgaatagtaatcttagggattttcagttctttgccttatttttattataaattattgatgatcagatataagggattcaattttcaaaaaagacagaagcacagaaaagtgagcagagaagccatgtctggggcaaagccagaagcacacactattacagtgactctgttgagggccactagttagcctttgctgcgttcactgccctggcccttccatcatcacctcaattgtcttttcccacactctttctttcctcttcttagtctacacagttgaatgatcccagtcaagagtccagtagttacaggatgggttttggcaagactatttttccttccttttccaaggcttttcaaaggaagcagaccaggtggtttgcttcttttcttgctagtgactggaaagaacaaggagagcaggaagtagagtagctgagaatacttctgatcttcttccattcatgtgatccaaaataggaaagctttttattctcaagaataatgcaattttgctggttaatctccatgtaaagttccagtaaagaccctgtaattttaaataacaaggcctaagaccctccattaaaatggaaaatgtctttatttctaagagcatgccatcatatactattacaaatgacaggctgattaaaatctagttgcaaacctggtataatgcacctttcacgtggctccccatgaagacagtttaaaagaccaagagaaaggttaaaatcaggggctaaaaatcaagaaagcatagagagtaaacctggagaagagcagaagtgggaagacctttaacacctgataaaataataacaaaatctgcaaagacttcagttttaatgaaaagtaagtctctaagagatttgactttgttctaatgagacctccagcattaatgatataccttttctgcggtttttgcagtctgtactaatttatattatccactgatttagtcagagcccaagggaaatggcaacatcaacaagcgactcccatccattgtggaagatgaggaagaggaggaggagggggaggaagaggaggcagtctccctctctcccatctgcacaaggggatcttcttcgcgcaacaagaaggttggaagcaataaagcctacctgggcttaagcttaaagcaactggcctcgggaacggtgccctttcactcgcctatcagagtctccaggtcaaattcccccaaaaccaagcaggaaattgacccccccaaccataataaaaggaaagagaagaacttgaaattgcaactttcaactttgaataatgctggacccccagacctcagtccaaggtaagagttcatatcatataactttctcacgtgaacgtggctgccttttatacagagtagtacctgccttcagccttctgagcctttctactccacagattcctagcctggaatcctcagcttttctgagttttgtgggcaattttttgagtttatgtgcaagtgtgtgtgtgcatgcaggatgggcaaaatatgttctcaaaatactaaatgttcagaaatccttctttactccttttattcattttgcactacctattatgttaaatgtatattcctaccttgtgattttatgatttatagtgaaaataaaagaaatggaacaaactccatcaatgttatcccctcaatgcttgatcttaccaaaagtttcataagcaatgagttgaaattaggaagaaaatgaaatgcagatttttatttttcatactattcttgccttattatcaaggacggctaaaacttagttttatttctggtctcttcaataagtaacacagcatggttccatttttcatttcttaaaaatcactttagaatccactaaaggtgattgaaagcgtgaaaaatcctgattccgaagatgttcaggggtaggccatggtgtagaaaagcaatagccatcatcaaaatcacataacagctgaataataataaataaaagcatgaaaaaaatatgtattactttttatgtttcatgtattttgcgagataatttcacattcacaattgcatttaatcttctcagaaccctataaagtagtttgtgttatctctattataaagttgcaagaagtgaaactcgaagggtaaatattttgtcgaagatctcagagatattaagtattgaaaggtggattcaaagtttgtttttctacttataaagcaagtggtctttctcaaatactatatttttattatttatttgaacaacattcttattcattaagataaaatattaaggaaaagataaaataggtttagcaaaaagtaggcggatgatatattttcaagaattcagttggagatggtaatttgaaaatattgcttaactcttcttcctaagtttatactaaaattaaacataataaattataaataggaagagactgtattggagctgagaaaggtttatatacaacataatcttacatttataaaaagaatatatgttctttatagagaaaataatattttgaggacatacatcaaaatcttgactatagtagtagattacaggtgatttttattttgtttttttgttacctttatgtttaaattttctacaatagactttttttttttaaataatgagtgggttagatactatttaccatgaaaagaagactaaatactgatttaaatataattatttaactctgacatttagagttttctctaagtctagagtagaggtgtaatcaaatttattttctgtgatgctaagggttaaaacctggagagtagtgatttaacatgaatttaggtcagaggacttttgtaccataccttaaagttttgaatctgagaataagtaaaagagcctctgtctacaacagtagtgtgtgataaaaaatataatgtgatataaaattgtgagctacatatatacttttaaattatctaacaaacagctacatttttaagcgtgataaaagtgaaattaattttaataatatattttatttgactgaatatgttccaaatattattttaaatttgaacaatataaaaatactcagtgaaataatttacattttttaaccatattcttcaaaatccagtgtgtatttaattcttacggcacatctcaatttgcacaaaccacatttcaagtactcaatagcaatataaggctaatggttactatattgaatagctcagctctagagcatctagaatttagaaatttaacataatatcttttaactctttaaaaatactggaatccatgaatatgaatccacagccagccaatttcctttattttaagtaggattgttgatggaattgaagatggaaacagcagtgaagaaagtcagacttttgattttggctctgaacgaatcagatcagagcccagaatttctcctcctcttggaggtaagatctatatttagtcttctcctaaggtaaaatatttcttattaacttgtaatgtttgttatgggcatttttttttttttgctttcctgtccttagaatattctccctgtcatagaaccttaccaataccattgaataatttgacatgagtttatgccatttccaagttaagatgtcatttgtgatcatttctctgtccagattggatgagctaccatttagcagcgaaggtaattgatatgccaggagactcaaatttctgctattcattagaggatggccatgttttactattataaatttagattaatccataaaaacattatctagaggaaatgccatgttgattgtgcactgaaggaacattggttatatttaaccagtttattcagtgtgaggttatatacttgaagttttccagatgataaataacttcggaaaggtataagcatgttggaaatgacggagaactatgtgatgtgttaacctttagtgatggtgaattaatgtgaaggtacctccaactctagcccaaatccctctctttacttttcaatcttgagtttgttgctcgtaagaatgattctgtcaacaagacaaataaaatgacaaataaactctaaagaagacacacctgtatttgataaaaagagaatagtgaacatgtgttgaataggcagagacaatccaaaacaattaccagcaaactacctaatgcaaggccagcaatcctcacccaacctccccttcccttcccaccaagttctaaaatccttgtattagaatgtcttggtaattagcaaatccctttatgaacaaagccaagcccaagaaagacatttgaatatacagttctggagatgtttctctggtagaataccagcatttcatctgaatcagtaattctttccagcactcatcatcttcttgggaaactaagggatacttgtgaaattccttgattgggagtgtgaagtgaggaaaatgcaaaaggataaggagtacagtcttgatttattgatttaactgacttacatatgttgatattactgtgcttggaccaaggagcaaagaaatcatagttatcatcaaactggtatatttgcaataaaagcctattgacacctcaattggatgtttacctttttggttcaactagagacagtgcacagaaactcaccatttcatccacatatttctagtcctaccactctcttagcttcctcctcttccttaacctatcacctacccctacgcttacacattcaagcatcaagttttctagaagcaacttccaaaatatctcttagttccctctaagactttctaccattactgctaccactctttctctagctatatctatctcttgcttgcattgctaccaaagtcttttctttgacctcacactgttttccatgcaaagggaattttattaattcaaatttatttgtattactctattcctatgcttaaaaccctaaaatggctttctattgcccttagtgtgaaattcaaacctattgcataattactttatataagttattttacttttttagtagagatgggatctccctatgttgcccaggctagtcttgaactcctgggctcaaggaatcctcctgtctcaacctcacaaaatgctgggattacaagcatgagccaccatgcctggcctactttttaaatgtttatttttcctgctcaattctaagctccatgagtgtcaactatattttctttattggttgctatctactctaaaagagggctggcctattgtatatgaccttcaatcattcgttgaatgaatggattacctctgcaagatatatctgcaaaacaatttcttattactctatttcagactgttttgaattacttttcttcccccaccaacaagttttctcctcataattgaccagaattaggatggtcttatctgtcaaatcttttccactcaagctggcactgactcacctgtactcttgtccctgacagaaataaatatatttggaagagcaaagtagagaaaaagtggagaagaagaactaaaaactgggagaaattaccctttagagtgatgcaggaagagaaaggcaacctgcagtggatatcagtatctgatatatatgtgggaggaaaatatgctcatgggcacatgaatcaatgtttagaatggaacgagagaagaaaaataatatcccttttctatggcttgagcactgactatgatacagttttaaacaatggtcaaagaaaagaaaatgtgccatcttggaacgtggtggtgactgtactcggggaaatggggtgtttgcaatggacacatccagtcactgtgggtgcaatcaccaccatgatgtgtgtccagagagtatatctggtgccatccagaggaatacaaaaagcttgcctgatccctaaaagacagtacagtgcacagacatcagaaaaggttaaaagtgatagcgtggactttctttcatattctaattgcctcgatcctcaaatataaggtttattcctaaaggactcattctgtatgtgtgtcacttttcagatccagagattggagctgctgttctcttcatcaaagcagaggagaccaagcagcagataaacaaactcaacagtgaggtatggagctctttctttggtcatgcctaaatggtaagaggagatataaatcctagttactcgcagaagcagtgtaatatagtagttacaagcatgcattccagaatgagaccaccatgggtgaatctctgctctgcctcatgtaagttgtgtgatctctgacaagtcacttaccttctctcaagctccacttccccatgtgtaagaagggaagaataataatgcctgccttatggccccttgtgaaattaaataaaataatctaggtcaatcatttagcatgaagtgtcttagatatatgcatatttggtttaattggtacattttaaacttttttgtgaccttccatttttaatgagctaaagcaaggtcgtaagttcacagaagaatgctgtttctcagtgtagtcaaatggcctgaactctgttctttcctctgacttgtatttgcttgtgtcaccttgggtactttacctctctaaatcttactatctattcatttttaacagttttattgaggtatatttatatatcataaaatttgtccatttcaccaatacaatccagtgagttttagtaactttattgaatccatcatctataaatcagttttaggatatattttcttcccccagtaagatctcttatactcattttacagttaatctctattcttatgtccagccttagacaaccacttatctactttttatttctataaatctgccttttctggcaattttatagaaataaatacaaaaataagatactttcttgattactgtcttaattggggtctctctcattaaaataaaataaaacaagttctgagactatatgggtgcaaaagtttatttgaaaagtgatacaggaagtataattaaagaacagagaagtaagacagaaaaggaaggaaagcaaaacagaaggatatgttagtgagacagttaaacttgtaaacaactggggctcaatcccactggagacctctgagagactatgtaggacaactcaaaattattcaaccaaggagcaaggaaaagtggagttgaggctcttcaggcaggcctgaagaaaaaaaattgctcaggcgagaatatgcagcaaaacctgtgcctatctttggtgtccagggtagacccaggcaagggcatgtgggcagggacagacagtgcaacagaatccttttctaggagtaaagtcttagtaatagttgatttgatgacactttggggaaaatgtaatcacgtgatggtattgatgagatttatgaaaaatgaagttcacataacttccagttatctgtaataagggcagactgagtagcttgtcataaactctgcaggtttctcttaaacctgtgtttcttcagcttcgtggagatttatgttttactaccatctcccttctgcacctgccctctctggagctgagattgttgctaataagaagtaagagagccgaaggaccgactaacaaggcagaaaaggaatactagatggtccactaactggtttgaaaatacttaaatcacaaagactcagccatgcactggatcacccaaataacctcttgttaaaacaaaaaaacaaaacaaaaaaaacaccgaaacccaaaacaaaactaatgcaactccccgttggagaactggatgttaaccttctgttcaacagtttcttttcagatactgctcttagctaaaaccacccatcaataccatttgaattctttcctctcatatttgagaagggcatttaataattttaaaaactgactgacctatatcttagttcaaatattagagttagtgattcttctgagaaaaaatatctatatgttcacctttaggaatgtagataatttttccaagttagggctgtaaatccacacagtttgttattttcctttgacaatgtgaatcgggtagatccattaacaaaaaaaaaaaattaccattttaaaaacaaaatatcttcccagtatgatcctgtattcacgatttcttttctttttttttaaattatactttaagttctgtggtacatgtgcagaatgtgcaggtttgttacataggtatacacgtgctatggtggtttgctgtacctatcaacccgtcatctacattaggtatttctcctaatgctatccctcccctagccccccgagatgacacacatctttttatcttgtcaaacatttaaataaaaagggaaagataaaatatcaaggtccaactattctttcccaaagaattaggttttccataaaggaaaatatctgatttattcttcgtcgaagattaagtagaaaaatctgatccttcacacataatttaatttatacacagttttgaccctttggatagtgcataaaaacccactaagatgggcagaataaaaatacaaatggacttcaaactgtaaaattatccctcttctaacctatttttctcttcctcatctttctgtaaagagtttatatagaaaaaaaactttttaaaagtccaagcctaattttaccattttgcctattttctactagtaacatgtgtcatcatttgattgctttattctttgtttttgctattatctggttaatagcaagcaagagaagaattgataataaatgtgggatgcactgcatgaaaaaaactctaccaccaaaaggacaaccgaaaatatgtgtgatacatgccacacagactgtgggcctttgtgtgaggtgtcagagcgctgcagaatctctattctgatatttgtttaaagatttaagacataaagaaagtgttcatcagtgtgtacatttcataatcataatctgcaagctaaatacagaactaaaatctgaaaagtaataatattggtaattacctacattcacagaatagttaggagagtttaaaagatgtggggcagctgctaatattagaacgctttgaccacattgccattgctttacagcatagtatgaaatagtgcgactctaaggaaactctttgaaaattacaaaaatgtcacaatagggccatgggctgtgtaagtcaaatgctccacttctgaaaaggtttgtaggtgaaggttagagtgcattctcatttctgaaatctggctgacccagaaagatacagaggcaaagcttaccaagggagactgtgtgctctggcacagcaggcagaaggcataaaacacactatggaagaaagagaattcactttggaaagagacaaatatttagattcctattctgtgatttcaacaaggtgtttactttccctaagcttagatttgtcctctattaaatgataataatagaacctgtaatcaaggattgttgtgagaagttaatatcatatgtaaagcactgagcacagtatcttcccttaataagtggtcaataaatgttgattccatcctcatacaaggttatgctttgattcaacaaacggtgactctcatataagcaccctccttctacctaacagtgcccagtagagtaataagtgagagaggatcaatgtttttagaataaaatgaaaatgaatggacctaagaagaacatatttggttatgaaaatcactattttcacctaagagactttttgctataaacatactccatatgaaattagaatagaaaacaaaatggcagattaatgatatttcaaagcatcttatcttaactagtttgattgtaattgtgctactgtattatttttaaaaaacatttattctgtaagacttatggattgagtagcaaatagatgcatatactagtttaacaatgtttaaccattacctgatattacaataaacatataattggcaaaatgataataaaaaccagatggaaaataacctgccaagcttaacagaaaggtaagcataaccatatctgcatttataaagtgagagaaaacaggtagcttgttatttcatccttactcacccaagcgtgctttggtttaaatactctacttgctgtattttatcattttattttgtgtatatgtaaaggggtcagagttaatattaggtgattttaatccatcttgaatcttaaacatactatggagaataaaatgtgtaacatgcctaaacaaaaaaaaaatgagctttgtagaaacatagcaacttgtattaattgattattgaggctgagaggtctcatgatctgcagttggcaaactggagaaccaggagatctgatggtgtagttccattctaattccgaagtcctaaaaaccaggagagccagtggtgtcagttccatttcgaaagccaaaaggcttgggactcaaaaagagctgactttttttttttcagttcaagtccaaagctagggaaagaccaatgttttagctcaaacagtcaggcaggaggagtttccatttacctagactttttgttctattcagaccttcaactgattggatgaggcccacccacattagggagggcagtatgctatattcagtctactgattcaaatgctaatctcatccagaaacacactcaaaagacacacccagaataatctaccaaacatctgggcaccccatgacccagtcaagctggcatacaaaatttactatcacatccaacaaatgtcttctgtttgtcagtccagtggcttcctctacagttgaagtcattggcctgtttcaatgtctaaactgctttgatgggaataattattttcccctttagcgatataataattcttcttaggctctgattggatctaaaattttttttaaattttcccatagcaaaagatgtcatggttttctttgtgagataaattaaacactttctcaaactccagaatttagaaagtatttcagttttaccctttacaacttggtatagtgtaagttacacatatatatgtatatgtgtgataagaaccaatatttgagagagctgagttcaattactgaggctcactactttgctgggaatcggagtgatatggggttgtttcctataacacattagcacgttgttaactttaagtgatatgagaagaccattcgtatcaacttgggctctagcattttagagaccaagctcttattgctattgagtccaaaagaaaggcctctttttttaggaatgactgtgtttgcattacatttcataattggataataggtcagtcatgtcctttaaaaatagatattacagaaatgtccttatatgcactattatcctaaggctttagagaaaattattttatatcatcactatgacctaaaagttagatttcaaatttaattttgtaatatcaggatcttttagctttattttctcattttcaactcctcaaaaagtccagttactgtttctaacatattgaagagtcctgccattatcagataagcactgttataagataaattatactgaggtaacaaactccaaattgattaaaatttatttctcgttcaagcaaaatgcctaacacaggtcagcagaaggggctgcaccatctggaatgtcactgcttggctgttttccatttgaagcgtggagcacagttgttcggtttgaaagataaaaacatcatttctgtcggtattttattaaccagaactaattccatgggcacagttaatttcaattggaaaagaaagtgtaagcttttgtatatcctaaaagaaatagaaaactggatactggcaaacgctaataatatctaccatagcacctaaaagctattaggaaaattttgtttctcatttaattttgctcaaaattcaattccaaatatcccccaatttaatgtattatatattatcaaagtaaaaaaataccagcaatgaaaggccttccactggaaaacagagaaagaatctgagttgttgtctaggttatacttgacaaagctaatagattaatgaaatctccctgagtcaaagagatggaataataagagaggctgttttttatttaagagttgctttactacttttctaaatgcctacagaagaaacaggatactactaatatttcacataaggaaacctgcatgagtaatatcttaaggtaaagttgattccttagtcctctgaattagtgttgccattatatcttttcattgacaattgagtcaactgaaacacactgacagaattgtcaggtcattccaagatttgtctatataggcttttttcttcttcatcctgatcatatatagttcttgatcatcaattttcaaagcaaaacataaacaaagactgtacattcactttttgacctagaacgacaaaattcaattaactgctggcaaaaccaacggtttttcttttaatttttagatatgtgttattgatgttaatactacgttttgtggacataggcttttaacctggaatgtttccaactaatttatgttttgtagaactccttttggttattttccagttcttaagcctgtataaataggcagatttataactctcatgagaattttactgactttaaaaaattctaaacaacaatgtggatctctcaaaagaaaaaaaaacgtatgtcattcagaaagcttctcctgtgaggggtggatttaaaatgcatgtaacttttggagactggttgttttcgtcctctttgcttatgattgcttatagataggactcttctcatctttgaatagaaggactaaatggatatatcagtaagggcccaagtaaaaaccaatgttgcattccaaatgggcaattttagcatgttgaattaaaaggttatttacaaagaagttagtagagtataggcaaaccacaaggggtagaaccacccctcttgataataacagcagaagttcaccacaactcctaggtcagaaggggccagagtagagagcagttacagaaacatgagttagagaaggctgggtggaaaaggtcggttgtcagaagctgtgctcttttgttttgtagtgacatagtgactacagttaataacaatgtattgtatatctgaaaattgctaaaagagtagatcttaccacagaaaaagtggtaaggatgtgaggtaacagatatgctaataagctcaacttagtcattccacaatgtatacatatatcaaaacatcaagtaatataacataaatatatattatttttgtcaatttaaaaaatcaaaataaaaaaagaaatttcaaaatatattggggctaaggatctgtctgtagaacatgaactagcagcactggcatcaacttgagcttattagaaatgcagaatctcaggccccgcccaagacctatcgcatctgagtatattctttgtctaaatccccagatgattcctatacacattaaagtttgacaagcactgttctatacaaccagtattctgagagcagacaaactttcatttgatgtttactgatagcagtaaagatcccttagccagacagcaatttgaatactaatcaaactttgtcacagaaaccaggaaaacagatgacaaaagcagtcaaagggttgataaataatagattaccatggtacagctgaagtaatgtccaaaggcctgagcttgcagaaactcaacgaagctattgaatcactttcaagactataattggtcattttgtattggtaatgctagacttgtaattcttccctaattataatttaagagacgtcggctgcacctgcaaaagtaaaaccctggttagtagtcctgtgtgacctagaacaagccattttaccttccaacattctagtctctccagctgtagacaaagatttacaacttttattagtaatgggattgaggtcctcatatggatgaaatgtatgcaagtgctgagtatgattattattttagctgacagataaaaagactatcacttgttctgaatgctttgtaaagcaaaagacacaagaatgaaattatgccaatcgtcttttttgttttgcctgcttatggagtttgtttgaacatgtctgaatcttatgataaatatgcaacataacaaaggattaaatgaaaaaccatttaatttaccgaatcatagcttgtaaaaatgtatatgtattagtagtggggcaggggaggattggtataattagtaccccttaggaaaattgtgtctagcaggaaaatgtgtacatgtttggcaaaaattgagtgacaggtcaagaactcttcaagctaagaagattatgtcaacagatgcattccccatctgctcactgaatgcacaaaaatggaaaccacattttttctctgcctatcaacggaagttccagttatactcaaagcacaagaattttacaccaatcatgccaatagccaagatggagaaatataaaacgtatgtaaaatgaagtaaagctattttatatgatactatatgtcattttatgtgaaatgaaaggtattgtcaaagataatttttctctggtctgcattagaaactcatacttctgttcccaaaaggcacaatctaaccacacaccagaacagtaaatctgtgtttacaccaaaaaacacacaatctaactgtggacactgacaacgcatggtgttattggaataataggtcaccagtatcgcagatagattatttaagccatttagtaacacaatgttttgaaagctcccattttgaagtgctggggacttccatgagacgtggatattatatgaaacattcttacctgctagagatatactgacacttctttatctttcagtgatatttaggggcaattgatgaaagtgagttacttaagttcaattgaaaataacaaaaagtcataagaaattcaccatgcaattcactattcattgaatgaatcaacaaagatttgtagagttctattatgtggcaggatttttacaggagcttgactactgtaaagagcaataaatacatgtagtagctgccctacctgccccccagctccacattggtccttattcaattctgatcaaaaccaggctgcacatccctacattttggctcacacatcctttatagagaatttttaatccatctgaatgcagctgctcaaactttggacttgaaatacaggaccttaatctacattttccaatggcatcaattattgctgtttctacttgctactgcgaagatccaggcaaagcaatactaaaaattcgagactttttcttctgatattagttaagtaaaattgttactgggaatggcttatctctccatgctaaggcagaagaatagttatagagataacggtagtttctattttctttaagctaaatactttctggattaggattccctgccttgcagaagttctctaccaagcttagtgcctgtgtcacaaatccactatcaaattgagccacctggaattctgacaagataccagttacatggggactaaagttttatatctgttatattatttaatcctcacaacaaggcccttatggaaatatgacacagaggagggtgagaagtagcattacaccaataaagctgattaaacatgagaggagtaaaccagatactccggaaatgtagggcaacaataactatttctaaaccaacagaagttctgaggaaacctggatacagcagaaatagaaaagctgtggtagtcagtgattcccttcttaggggtatggaaggatcagtgtgtggattatcatggccagttggcaagtcagttgtcacataggtttttattcatgacaggggatgttgtttaacaagagcaaatgcgttgcctgcaaaacatctaatgatttgtgtggttaatgcatgatgctgggagaatagacaagggaagaatctttaggtgcttcaaagtttttggatacaaaactgtaccacttggaagcacagatggtgttttcatcacttcttttttttaacagttgggattctggaagagatagagaaatcttggatgtgaacaattggttatgcagatggtgatgataaactggtttggccaacagttttaaattccaggctgatggattcttatccatggaagaataagaaggagaagggggaagaagaaaaaaagaggaagaggggaaagtggataaagaaaatgtatattaataaacaaataagaatgtatattgttatgtttcctttatgcactgtctttataaatagaatctgaagaaatagctatccagagaagcaatcagggatgcaaaatgttagccaaatttcagttgataaacaactcttaataacttaattgaattcatcacttggcattcataatgtagttatgagatctaggaatcagtcattgggggaaatttcccagagaattaaaactacccatggaaatcaagtttatgctgggacagatgacaaagcaataagacaagtgaaatccagcagaaaccttggccaacggagacatatttctacaattatgaaggaaacacaataagggaaaagggattcttaacagtagaaataccacctgcacttaaaatgaagggatagtcaaggctttggtttaggaaagttgtatatgtgaattctaacagtcatacctacttttagtatatatacttggaatgaagatggccagttacagcttttccaatacaattttgtatcaggcaactttcccctaaaatatttatggtaaaatcatgatataaaataatatcagaatcaaaggcaatataacaaccaaaagtccttcaaaatggaggtattgtatttatttttacattgaagatttgctgagtgcatgttgtattctaggcattgccttgagaccaggagatactgagataacagtttctaccctcaaggaactcaacgactagttggtacagtctcatgtgatgcaaagtggtcagggttaaaactgctatgtgagtgtcaataagccaaggaaaggctctgctgagaaaattaagtattaaaagaagtttgaaggagaagattttcttgccagacagagaagggcagaggagaagagcccgcagtcagaaggaatagcatgcaccagggcagtgaagggtaaagctcactgtatctgatggtgtgcaagggagaaaatgcaggacatggagccattaaaaaataaagtagggtttgtgaagggctttgtattacctgctcaaaaagattgtattttctaatatgagtgtcagaaacatttaaatattttatgctgctgttgaggtaagtgggaaaactttggctcatttgatcagaacgattttgtttgttttaattgacgtatctctttgcagttaagttgtattttgaagatgtatcttcttttttcttttaattatacttttaagttctagagtacatgtgcacaacgtgcaggtttgttacatatgtacacatgtcttcttgagtggacagagctttgttcacgaagtagccccaacaatccttttttagcaaatgcatgtcttcttaccatgctatgaagaagcacttgagccaccacccttagatagtggaaacactgcattctttgccttcaacatttgatgaagactgaggtccttcctgttttagaataaattttgatagcaagcacagcaggaagcagtaaacaaaaatgcagtaaaacttgatggcattttctgtggcagtatgttgtcacctttactatcaccacagtctctacttctaggaaatgccatctctccttgtgacagctggctttgccatggtaaaaagagagatcccttacttaacacaattaattccctcatgcaactttaataaggttcaggggtgtatccccagagacacagtgacaggaatcttccctaacataaattgattatttccctctagagttaaagaaacctctgtttccttgagttacttgctccttttagttcaagctaggatagtaatttgttttctgaaaatgtcagtgcttgtttatgttcctggatcctgtcaagactctggattcccattctaagttcacggtctcaaagttgtggcaaatgcatggtaagccaggcacagaaagacaaatattccacgtcctcactcatatgtgggagctagaaaaatgtatctcatggaggtagagagtagaatgatgattaccagaggctgggaagggagaggttaggatgaagacaggttggttaatgggcacagaagtacagttagattaaaggagtaagtgccactgtttgacagcatagtaaggtgatataattaacaatcacttactgtatctttcaaaatatctagaagatctgaaatattcccaacacaagtaaatgataaatgtttgagatagtggttatactaattatcctgatttgatcattatacactgtattcatatataaaatatcacatgcatcctataaatatgtataattattatatatcagtaaaaaaagaatgtgtctatgcaaaggtatttcaatcatggaaaaatatctgtttattttgaaaactagaaaaatagttcatcagaaatatgtctattaacatatctgtttccagttcttaccctgaggcaaactatttttgcattcatatagtttgctatgaagatattttactgtgtttaatcagtctcctacatttttagagatgacgctatttacttaatgttgaattaacatttcacccagctttttactcatgaggctacctttctgtgtcattgtgctctttacgttctgactacattaggaaaaatctctcaatgctttcttaagcaatatttctttttctacatgataatattctatagcagaatgaataccaaacttagaagtcctaaattctagactgaagactgtcattcatgaaataagtgaccttaaaaatgtcctttcacctctgagtcttattgctcccattttacaagttgagaaatgatagtacatccctgcctttctcagcattgtttgtagatccaatagggaaagtgtacctgaaagcacattgtataaatttacaaacatacaaacatttattgaataacataattgctgatgtgcctaaaattcaaacttattcttcagagactgtgcctttatttaattctcaataaaaggtcaattcaaagcatttttattgggaaatgaactaatgtagccctagtgagtttcatacaggaatttagcttggacaacctatatgaacggatggctaatgtgcctctttaaccatctcatttagtggcagccttgtcttctgaaattatgacacaagaattaatcactttaagatggaacccttgtgaatgtaggtagtgcaaagatcctggggtaatgatttaagtgtgattcatgtgctttagaattgaagcttggcaggtaatgaaattgacaacccatagtgaagatttcaaagcatattgaatttttctcatattcattgtttcagttcttaaatgtgaggctgagagatgttgttgtcttcagaagttttagatctgctgaaaagcctggacaagtattcagttgaatcccttgagtttcatgccagcagtagggcagaaatagttttggcctggcaatttcaaggcaggtgttaccagttggttgcccaaaccatggaaaaacctccttctggcctttttaaatgcctgactttgagcagtgtcacctcccgatggacctgccagggagaattagtttcagaatgcactcacagtaagtagactgaattaagttgctggatgaattaggaatatgtacttaaatgttgaagaatgtctgcccaaaacagcagtcttgaatgaatcttcagttcaatgaagttgaactacctctttttgtttcctgattatatttagcccataggttcagctgcttctattagcattttgtggttcacgatagtaaaataaagtcatagaaagtcctttataaaaatacaaagtattatagcaatgaaggcaaaacattacattatgttagtattatgaatctaaccaaagactagaaaatacatgtgtgtgtcctgctttctgaaatatgttttcctcaatttgaagaatacaaatcttttagaaaagctacgtttaagtgaaattcaattttctggtggtattccatgattaaaatgctgatgtggtcgttacgaaaataaattctctaatgaatgttattatgtattttaagtataaaatgaagactcttcaatggttcttaagtgtttgggccatgacagctaaatgtctcacctagaaaactgaataaagtacctacaacacaatttgttgttttataattccatggggtttcaggttcactgatgcgttccaggactctcagaagccctgcagtgcttatctctacttacgcaccttgcaggtctttttctttctttccaactctcattccatagctttccctttttctgcaaactttctctgtagcaaatctggtatgagttattttgtagcatcctcaccgttactgaaggccactttgtctctggcctataataagcataggcttcaaccagaaatggcaagagtgagacctaccattcactaggtgtctactccaaataggtagtagtgcttagtgtgctgagtgctttacatgcagtatctgccactccacattgttttgaagtgtccagtgatttttgtgcactatcatgcatcccattcatccaggggaagcgaaatatatcatcagtactttagagatgatggatctgtatctctcattctgtttaagaatcccaaatcactaattaagattcccagactacttatgcccctctaggctctttcagaatgaggatgtctttagatcaggatgtatgttcattcaaatgcttaacctacccattcaccccttgggcttggttggagttggagcagcctttcaggctttcttattaagaaatttctttttcatggctcacgcctgaaatcccagcactttgggaggccgaggagggcggatcacgaggtcaggagattgagaccatcctggctaacatgatgaaaccccgtctctactaaaaatacaaaaaattagctgcacgttgtggtgggcgcctgtagtcccagctactcggtaggctgaggcaggagcatggcgtgaacctgggaggtggagcttgcagtgagctgagatcgtgccactgcactccagcctgggcaacagtgtgagactccgtctcaaaaaaaaaaaaaaaggaaaaagaaaaaaaaaatttctttttcaccaagcaaatgctaaaatgtttaagaataaataagtaggaataaaagaaaaccgaaagaaatatcacttccctgcttcatttctctgaaatgtggtcactactatgcacctctaactattgtctttcactttgctctatccacataggtaacaacattgactcaggaagtttctcagttgggtaaagacatgagaaatgtgatccagcttctggaaaacgttctgtcacctcagcagccatcacggttttgctctttgcacagcacctctgtgtgtccctccagggagagcttacagaccagaacgagctggagtgcacaccagccttgcctacacttgcaaacaggcggggctgcttatacccaagcacaactttgtagcagtaatatcacctcagacatttggagtgtggatccctcctctgtggggagcagcccccaacgaactggagctcatgagcaaaatcctgcagacagtgaactttatcattctccaagccttgattattcaccttcccactaccaggttgtccaagaaggtcatttgcaatttttaaggtgcatctctccacattcagattctacgttgacgcctctgcagtccatttcagcaactctctcatcttctgtctgctcctcttcggaaacatctttgcacctagttctcccaagcagatcagaggagggcagcttcagtcagggaactgtgagttccttcagtctggaaaacttaccaggatcttggaaccaggaaggaatggcatcagcttctacaaaacctttggagaaccttccactggaagttgtcacaagcacagcagaagtgaaagataacaaagccataaatgtatgatattagtgcccatgatgcagcagctaatttcaaacctaccactgcatgacagttttagtttgcctttttgcctctggtgggcatgaagactgagcaaagctgggaatcctgcagaaaagagtgtgaggagccagggaaaggcagaaccacctccatgctgtagcaaacaatttctagatactagaagcataatagaaacatttttctgtacaggtattaaactactggtctgtttgacagactttggtaacaatccaaagaccctgagggtctgagcagctagaagtcctagacaaagaacttgtggatgacttttgtcccatgtggcttttgtgaagtatggcaaaggtttttcatgagtgcctgattgttattcctgaacaatatccatagcactgttggcctcaggagtgcacagctcctgctgatgtatttttctttttgtgaaggcaaagggacaattatcactgcatgtcatctcctagacaatcagtcaaatagagctggtggccagtggttagctattcgcacgttatttgccatgtaaatgaaaacgtctttatttatcaaaaaaacacagaggctatttttatatccttggtatgaaatatgtatttaaactatttaaatatttataaagaaatgaatgttttcttttcattttggtaaaaaaaaagcttgctgttttaacaagaaatgcactactgttgtgtatagtagatcaaaaattatttattactaagaggatgtagtttccaaaggaatcccccattttttctgcatgcagtttgcaacaaatgtattctcatgcttctggattataaaagaaaagtgaagtcatattttgttaatgaaataaaaacatggactgagtgtcaactacatgagctttggcatggggatagagaggctccatctaggctctgccaactcatgtcaatgacatgatttaaggtcgttgtgccagcagaaatgtctctcctctaggtatcgtattttgttgctcaagaatccaaaatgggtctgtggacatagggcaatttggggctcaaagtgagggagaaaacctgggtgtgtcctttcccagtgcttttcttttacaagaggtagtagactagtggaaatccccaaatggagccaagacttctgagctataacttgtgggagtaataccagcttgcaatgggtcagcactttaccttttttctttaaggctcccaacaatgctatacagcgcagttgtttccattcctatttttaataaatctcaggggaagcctcagagattacacagttaggatgctgacacagtctagaatccataatgctccctacatctcacactaacaggcaaattcagatgctgggattggcaatgatttaagcaccttcactaaagtcttattttatgttttagaacagttacagtctaattgtcttggacattttgggaagatatattgggttcacattctggagttctctttattttccaccacaaaaaataatctgagaattgtatcattaaaagtatctaaacacaccaa

SEQ ID NO: 21 - DNA, 80337 bp, Homo sapiens
gtactatggatatagaggagagaaatcgccaaatgaaaattaacaaatacaaacaggtagccggatcagatcccagactggaacaagattaccattcgaaggcaagacatttttctttttaaaagttgtaaaataatcaatcatatgaaacagttagattcttttaaactactaaatgcagattagtcagacacaaacatataatgccatggccccatgatattattaagtgctaaaatttatgtgtttgtataccgctcttagcaatagaatttgccttacttaaaaaaactattataaaatacagaagattaaacatctgaaggacaaatcttttacagtttttcattttgtaaaatctatagcccctcaaaaatgtttaagaacttaaatgatcttatggttttctttcatatagattttttcccattttatagtattttaatggaatctggtttattactgaattattggaacaaaatacaaatggtgcctgccttatagtggatcaacttacaagtttttgactttagggtagtgtaaaagcaatacacattcagtagaagccatatatcaagtactaatacaaccattctgtttttcactttcagtattcaataaattacatgagctattccatactttattataaaataggctttcagttagatgattttgcccaactataggcaaatgttaagtgttctaaacatgtttgaggtaggctaagctaagctgtgatgttcagaagatgtattaaatgcattttcaacttacagtgggttcattgggacataagcccgtcatgaagcaaagagcttctgtacatattcacgaagtgctgttagaggttcaaaagtcttttggtatgaatcttttttaactactttttgggaataagttgaagtatgaggtctaccaagggaggaaataaagtattaattaattgttctttttttttttttttttttttttgagatggagtctcactctgttgcccagactggagtgcagtggtgcaatcttggctcactgcaacctccgcctcccgggttcaagcgattctcctgcctcagcctgccaagtacctggggctacagacatgcgccaccatgcccagctaatttttgtatttttaggagagacgaggtttcactattgttggccaggctggtctcaaactcctgacctggcgatccgcctgcctcagcccaaagtgctgggattacaagcgtgagccactgcgcccggcctatttcattgttcttgtactccattacctttttatattcaagacatttttagttgcttgatattattcgtggtcaaagtcatgaaaatactttgttctgatatagctattgaagatttaataaaagaattaaaatagcaaaatttactcataacatgtagctgttatatgctgttatgacttagtaattgaatcattatagttgtaatatttgtggtctccgtgtaatagagaaaagcaatctggattttttgaaagttaggcctgttttatccttacatacttaatctgcagtttctattacattacatcccttcataacctcaagaactaattaagtaaagcataagtggctatgttgggtatacataagtagcaggtatgtacatatgtaccagtttctagcttcttcaataagacaacatagagaaggcagagattcttaacatcagcatctacttctaaactaccagtctcttccccagattacattattaccaacatggtgcatacaaaattatttatcacagaattctgatatactggaaatgtcacaggcctaaagccagacaaaagtaaatttaagacaaattaaaatagccttggctttactcagtaggttctaaatttctagaactttttcactaaaatgaaaatatgaataacttcaaacaggtatagtaaattttgtagcaaataattctataatgctataatattttagaacattcctaactatttgagttggatatcagaaatgatatctgtgtttttcatttgtttgttttgtatttctgcctacaactaaatagacacacctgaccttttgtggtttttttatgctgtagtctctcatctgttcaccttgtataatccagaggccaaagcataaagtcctgataaaataagatactaaattttttgtaaatgtgtcttcagataacataaatttgttggtttatattttactatacttcaggaaggaatgtagatgatttataaaaatacttatatagtctcaataatattgtcagtgaagaaaagatcaagagaaaataaagtcacgataaaacaaggtaactccagaagtaaagtctgtgaaaaaaatgtatagtctaagatcctacatacccactacatgtgggcaatgtcaaccctgagcttcctaacaagcagcaagtaagtgtaagatcccacatacccattacatgtgggctatatgtcaacactgagcttcttaacaagcagcaaaggcagaaagggaaacttgatcagttatatgatttacattgctcatacaataaagacaagtttcttagaagcaatagcaatgattcttgttatagaaacctgacagaaatttattggatggaccaaaggaatactataggcatagctgggatttcttttctaattttgattttacttcgattcatgaataaatgaatgcttaaggcttcaaagttttatatctttgacagcaatcattttaagttgggaaaaaataaatattggtaaaaattaattgtactaagcattataatttcctagatattctctaaggcagtagatcagcaacatcagcatcacttggagacttttagaaatgcaattgtctggggccccttcagaccaatggaataaaaactctggagttggggtccctgtggtgtttgtttgtttgtttttgagacagagtcttgctctgtcacccaggctggagtgcagtggcaccatatcagctcactgcaacctccgcctcctgggttcaagtgattctcctgcctcagcctcctgagtagctgggactacaggcacgcgccaccatgcccagccaattttttatattattttagtagagacggggtttcaccgtgttagccaggatggtctcaatctactgacctcgtgatctgcccgccttggcctcccaaagtgctgggattacaggcatgagccaccacgcccggccgggtccctgtgttttaacaagtctatcagatgattctgatgtagactaaagtttgagaattactgctctaaggtgaagaactattgtaaaattatcctttagataattgagttgacttcctcaattagggtttcaactagaagccagaggtgaatgatgtcttcaagaaaatggagacattttgagaataaatgatctgacatctttataaggcctttaataatgtctgacaaatcctactgaatgtagaatacttatcactctgttttctattgccaggattatgcaggcagcttacctcaaaatataatcaagtctcttaagtacaactttttaaggggttccaaaatacaaccctattttgtaccacaacaaagcatttcttgatgtggaactatctttgctggatcacctatctccccatcatctgaggttcatcttcctctgatatgtcaaagagaaagttacagaggaatcttcttcagacatatatatattaagttacattaattttcaattaattccttagattaaaattttcaacatcatttctctcttttttgatgagggctatttagcttatatttacattctttactttttattttgataacaaatgcaagttatagagcctcctactgagctatgtgttttaacattagatctagttgctgaagaaaatcatttaacaaataagggaactaagatatagaaaggttatgtaatctatccaggtccacatagccactaagtcatggaaagtattacttgggctaatttagtttttcaaatttgacataactgtgatgaaatccaaagcctcagacatatgaagcatatgctgtctcctgagctgtattcctgaaattccagtgacacaattgtgaagccctgtgtggaatctaattgttagcctaggtttttttttaaaaactgtacagttcacattctacatggcattgctccctgaatttctcaagacttctgcattgatagttttaaataattcctactaaatttaaagaaatcttcttagtaactcactttgaaagcatctatagagcaatgcctattaagctactgtctttctaagaatattttcagtatactagaaaacttgaaagaagagagtctatttttaataagagcagcaaaggcatgtacagacatgatttctagttaatcagtggatgatttctcagggagtttccctcaaaatagaatttattatactcaatgtactcttgcatgcttcttgtactttttttatcccagcttgaatgtgattcatctattcttagcaataatttaaggatcaacgtattttttctataaaatcaactttctttcctctttattttctcagaaaaatgtgatttattaagtttaacagtgtaaattatggttcaccacaggtcaactacccttctgtgagttatataatgataaattggcataattatcaatacttaaaagtccaacaatgtatttatacatggaaattaatatggatgatttgataatgcttatttaaacatatgagctttagtttttaaatttgccatatttaatatttttaaatgttcccacaagctatatattgctatgaagatactctttgaaagagtggccccatagcatttcaacaaataaggctcattcaacaaataatgtttattggcacagtatttattggaactcaaagcttatttctctggaaaaaccatgctcttttttaaggagtatgttgtggcaatacttctacaaaattatcacaaaaatgtctcactcctattatagcagttatatcataattttccattctcttatttgtctccctggaattaagaagcagtataatctatgagttgcccagatctcttcaaatggaggccagaagcctatgataatctatttaacccataatataatagattgggttagaacagaggacaatgtaataaaataaaggaaaagaaagtttgtctccatttattgtgcatgcctgaccctaggcacttttcacctatatcctgtcgctttttccccaggcttctagtcttttaggcacccattcacagatctcaaagatgtattggggaaagcaatttgattaaactagtttacgttaaaatatgaatgacaacacagagcttcattttttaaaaagcccttataaatacaacataaactgaaattggtggacttataagcagtattaatagaaaatatttcagatagttaaagtatgtttggtcaattaaaatgccactgttatctaaactgtttgtttcatttgattagcacttatgcgcttctcaacactgagaagacatattcagtgctaaccttaagtattttacattgactttcaaggcacaggcaatgaggggagaaaagttgaggcttgttacaagtggtcatatatgagctcttcaaaaatttaatgtaagtcaggaatactttaagtctcaaatatcatcagaatgtggcagcagtgggtgagtagtgtattagaaagggcacagcctggggtcaagtggactctgcctgggtggcttggggtaggtttaacctcacagcttttttaatctattaaacaaggttttggtatctattttatagggtagtgatgaggattaaacgagatgatgtatataaattgtttagcacctagtaaatgctcaataaataatgcagctaatattagttattattttatagtaacaacagcaaatataataatagacaccagatatgaatctgacaagaccaaaaagaaatgataaagaaatgactaagataaggaaaatgattttattgattttagtgtggctcagatatctttgaatgttccctttactctcaaataaggagattcaagtagcacaaatctaaaaggaaaaatgaaatttagaggaaaaaaatttatgaatcttaaggggatatgaagattttttttaattaaaggagactggaacataatatgtgatgaaaaatcacaaaccaaattactgaaattaagaaattatgctatcatggttgacattaaaggtgactggtccttgatgaagtgattaatagacatgcatatgggtgtgggtgttttcaaagaaatactcattaatagtgatgacataaatggacctgacaactaagaccacgtttataaaaggcaagttttaaaatgtagattagatagccttatatatattatcaagaagaaacatgacaatacatgaatttagatataatgtagacatgaagaaataagagttatgttttaattttacagcagtgatagaaacaaaatacttggggaaaagtatttttcttagggagaaaaattgagctgctgttagtatgtaactcagcccagtaacatgatgaggtggatagagccaggctttgtgcctgctacaggaagagctgctgcagcgtcagttctcaagctaccaagaaaacctagtattcatgtaaaacagacgtcattatgcatgtgtaagatggaatcctctgataaatagaacaagaggattctaataggcatgatcttgtgaacgcagtctcagggagtacaataagatgttttaaatagaaagtaatgaatgaagcattcttctttggaataagcaatctactgtttcatgaacagaagttgggttcagattttcaaaaaaatgcctgctaggcatagtctaacagatatccagcagaatggttttctatttttgaattagaattaagatcacttactcatgattttcaactcgagccaagtcaagtaatcttatcttgtactgatgaagatgtcagagactatgccagtggctgtacctggatttcttcaatgaaacacatcacttctataaacgcttattttactttttcatattttcctattattttatttatttcttcatgcctcagcaagcagataacttcaggtcctatagcagaatcccaagagaaatatctggaaatcagtgaacctgctgatatgggagcataagagaaaaaaggacagcctacattacttggaagtattcttaaatgccagactagcctacgaaactatgagagtatgcttagtactcaatgatactgccgcctactatactccccacctctccaccagctgaggatacatttgaccaagtatcgcacacttttctttgcttcctggccccaaaccaggccacagtcttctaagctgtctaagttgcttgtccaagccagccatcctccaggattttaattagtcacctgacgtgtatgttttatttttacatcaccctgaggtatttcctttatcaagtatatttatgaagatacataaacttagattttgaaatccaggttattaagctagcaaataagagcagcattatataatatagctgtagaattgcacgagatgctaatggtaatcttatcaaggcctgattaaagccttcagtcccacttacaaaattgccaaatggttatatagcctaattaaaagagtcatagttcagaatgaaaaatgataaaattacatttttgaaatcatttatgcccattttcccccttctatagtttttttttgaattcatgtttgcaaggatagatttctcatttgtgtgatatcaaacatccatcaaactagcatttaaaagtaactaaaaatttctgtatgtgtttgtataatttcttcctttatgagataagtaaaagaaggggtgatgtcaagagagaaggagccattggaagtataatttcttacaattggtacacaatattattaataactatagcagacacagatttatagcagaaattctgaagtcttgtttacagtaatagagatatatggacagtttgataatcactcttcaatatatttttagtgattagggttaaataaagactacagagtagtattaaaagtgtagattccttaaccaaactgcctagattaaaaccctacctcttatactatctgtatgaccttgggcaagttacttaacattcttgtgcctcagtttcttattctataaggtgtgttaataatagtacctacctccaaggattgttttcttttatcttttttttttttttttacatagtctcgctctgttgctcaggctggagagcagtggcgtgatctcaggtcactgcaacctctgcctcccgggttcaagtgattctcctacctcagcctcccgagtaactgggattacaggcacgtgccaccacacccagctaatttttttgtcgttttagtaaaaggcagggtttcaccacgttggccaggctggttttgaactcctgacctcaagtgatccgcccaccttggcctcacaaagtgctaggattacaggcatgagccaccacacccagccagattgttttcaagattgtctacatataaagattaaagtcttagagcagagcttgatatgtaacagcaatcagtaaacgttagctgtgatatgataatgatggttgtggtcgtggtggtggtggtggtgacgatgatgataggaaagaaggacaaaaggaagaaacactgtttccaacagataacttccacttaccaaagcccttgggggttccagtgtatatttgttgtcatcaggaatctagtagagatagataagtatatctttaaggtaatcttaaaaacaggtggggagaaaaggatgaaaaatttaaaaaaatgatacttttaaaagcctaaaaatgatttgtcttttttgcaaatctattcaaatttttttctacccaaaattcttattgtatagtttatattccctagcaagctgattgtatttaaattttaatctaaatatctgtctattggtatagatatacctgtaggcagatataaaattataatgtatttccacataatttatacatctgtgtttacacatacacttactcataccctaaagctctgaactcagggttcagagctttagggtatgagtaagtgtatgtgtaaacacagatgtataaattatgatttagctgatagaagcaacaactgttcatttattccttgcctcattggaagaaattctcatctatttcttgtctctcctgttacataaaagatctacagttaaaaacttggtggtggccgggcacggtggctcacgcccgtaatcccagcacttcgggaggccaaggcaggtggattgcctgaggtcaggagtttgagaccagcctggccaacatggtgaaaccccatctctactaaaaataccaaaaattacctgggtgtggtggctggtgcctgtaatcccagctagttagaaggctgaggcagaagaatctcttgaacccgggaggcagaggttgcaatgagccgagatcgctgcactccaacctgggcaacaagagcaagactccatctcaaaaacaaacaaaaaaaacaaaccaaaaaaaaaaaacacttgatggtaactcattttaatgaaattttagcgattttgtatttttatttgtgattaatcttcgattttaaaagtttctagtttaggtttctttttccttaacatcccatattagttgattagggctgctataacaaaataccatagaaggggtggcttaaagaacagaaatgtattttcccagttttggaggctagaactttaaggtgttggctaggctggctccttctgaggcctttccatggctttcagatggctgccttcttgctgtgtcttcactttgtgtgtgtctgtgtcctaatctcttcttataaggacaccaatcatattggattaggaactacctatgtgacctcattttaccttaattacctcttgaaaagctctagcgtcaagtacagtcacattctgaggtactgaagactaggacttcagtataggaatttgggaggaacacaattcagtctataacacatctctacaaagtagctaatgatcttttaaattaaaactttattgcattgtgaaagcatatttgattagaatgtgaatagggatttttaggcaactaaccgtagctgttttgctttgaactttttatttcttttttgattttattacttttctctatttcttcctatttttacaactgccttctcaaatcctaagagataaaatattttggttttgtgtttgcaaatgcatcttaaaaattagctgtcttagccatgaaaaccacatttaaatatgactcgcgtagccataattttatgctgatattcaagcatgggtccctttcctttagatgtatttgtgaattgctaccttttaccatatattcacattttaagccaggaaatataaaaagactatttttaattatgagtaagtcttccagtgtggcagtattatgcaaaaaaaaaagtcatttgagatgacaaaaacagcaacttgtatattatagaacactgtagaattatagcagaaattttaacttctccctttttagtaacataaagtttctaaaaactgacaaagagagaattgtagataagttgcaggcagctacttgcaggtaagagggtcaatctgtggagaatagctgccattgccaagagtgcagtaccctcctgtaattacctaagaatataaaggagaaacatttccttttaccgtcagcaaaataaaaaataataataaacatatgacttcatctttgctttcatcaaggctccagagttgctagcttgttaacagctagaatattctacagggaatgaattatagtagactacagaagggaaaggtctcgctttataaaatcagggaggatatgggaaaagaaggaagaaaatatgatcaaatagaacagatacattctttccaatcaaatttcacataactgaaaggattaagcatgatatatatatatatatatatatatatatatatatatatatatatgaagtaaaagaatatggaaaacaacagataggtgaaaacatatataccttctgaaccaaccatggcattaccacataaaatacatatattctgttttatatgtggaatatttatgtcttttatattaaactatacacttcttgagaacggtgactatattattcatctttgtagtctctcagtagcatgtactttgccttggccacaataagcactcaatgggattaattttagtgaatgaacgtggacgtggatgctgagagaagtaggataggatagtttgaaaaagattctagagaaggtgaattttaagcattttgtatcaatataagaacaaaatatgatttttagaagaagatataggtagattattgggtaatagtcaaaagcatgttttctaatgggcatacaattattgatttccatctagagataataatagtggaaagaatactgagatagaatgagaagattgggcttctaactttggttatgccattcatgtaataagactttggataagttgcccaatagttcttcacaactcaacttttttctatctacaaattgaaggaaccttataaagtgttaaacaaatatgtggtactttggaggcagcattgaaaagaccactatgaattaacatttgggttttaatcagtctcatcattaattaagtaaattatttaatctcagagcctagtcttaaaattagatttgaaatatattttctatattttatttctttcaattctaatgtttcattcattgattgagtagtctgatcagtgtaaggctctctactagacatgttctcacaagtgcctgaatctgtataatttttaatgaacttgtgccataataactatgacttagagaataaatttatatgtgtaatgttttgcatattttacatgaagtaattgataattaagtttgaattgacacttgtgtaaaaacctttagtcaataaagtcagtcatccagggtaacatggaaccattcacatctataacttcaatttagttcagctaattataatacaaatatatctacaattttgttatgtaatggctttgttcatcagcacaaaattcagttgtaatttttctttagttggaaggattacagatatcatttattagcaaaataaatataacgttttattaaacatttggaaatttgattacttctattgcatcaattttgaagatcgtaaaataatactccagtctggaaataatatagctaaccttggaatatatttcatatgaaggaagggactttggtgataacttcagagagtggaaacatctctatagcactaggcctagcacatgggaatgtccataatcgtagttattttttagtatttattataacatgggaggtaggagtaataaaaactaacttacagttgaacttcattctgatggatgaattaaaacttactacctcaatataacttcctgagtaacaaagaaatcgctgtgattttatgattggccattttcaggtcatttttatgactcggaatgcttacaaacaaggccaacagtctccagggtccagtcacataagaacatgttacttcttaagcccttttcgattttctgccaaaaaataaaatcacctgaattttaaatgagtttaaagggcttatttcaatagaacataaaacatgcttttattcaatagaacataaaacatgtttttattcaagttagttaatatgatattattgtcaaagttttactttgttaaaatccatccaattatacttacaagtagtgttattttaatgctgttttgtattctgattatttaggtcattttagatagatttttcaaaatttcaaaaaaggctgaaaatctttattttaagcatatccctaaagttgaaaacaatatgaatattttcaaaagaaatcagtctaaacttgcttgcccagtgtcccattaaaatgaatacaaattatcacttttaattaaaagtaaaaacaaatttgacaataaaagtgaaaaaaaagtttaatgaaaagaaatagaccttataataacaagttgtataatcttaatcacttctctatttctcaattttctcatctataaaatgagaaagctagattacattctctctgaggtatcttttagctttaaaatatggtgaacttgtgaatgattcagtgatgaggaaataaccaaatgtgtggttcagtaccgggtaactttcctgggctgttctcttgaacaaaaaacaaaaaacaaacaaacaaaaaagtggttatatgagtcttctttccttctctgttttttaaggcatttgaatatttttttttcaatttcagtggtcattcagtggtcattcattctctctctcttacctgcaagtcagaacttcatacctcgggtattgctgaagctcatcagctttaattctggattctggttctgcaacattaaagaaagaaaatgccagaggaataaccatatgaataacaataaaatgaaggaaatagtgagtaaagaaggaataaaggacggaagggaaaggggatgaagagaggggaaaaaagaaaaggaaaaagagaattaaaggaaggagagagggaaagaatggaggaaggcaggctagcatatcctttcaatccaagagttcactatcaaattagagaaacgcatgtacataagtaatgatggtacaaaataggctgtgttgaatgatataatttttaaaaatacacgtacaaaggaagaacagcaaaagaaatattcatttggctggtagaaatctgggaatagaatagaatgtaacacatgaagtgaaggacttctcaggctgaagagagagcttaaacaaagttatggcgttacatgagcacaagccatgtttaagaaacagctaatagttctttagtgtggaaatatacaacaaatggggatatgtattcggagaaaagaatgtaaaagttggctgggacaagattgtggagaactttgaatctctcagttaaaaatatagaatgttctacattttaaattttatgtttatatttttatattattttaaatacctgtattattttaaagtctgtatcttatatgttaacatctatatatctatattcttttaatattttaatatctgtattacttatgttctatattatttttctatattttatacaacccatatggaatgatgggtttggaagatttttgaggaagttgctgacatgaacaaatttgtgcttttagaaggtaattttaatgatatacttaagatgcatttgaaaagaacattacagacaaagagtcccattaggaggctattgtagtagtccaagcaagaggtaattgttagtctttgtccctgctttgactgttggctccatcccaaatggtctttctgtaagcccagttgatgcttctctgtcttctcacacagggaacaggagtagtgggcctcttcagacttccaacagaatataattatatttgccctatccctgaatttgatagatcagagcaattctcaggccccttcaggttttttaacattacatagttattcaggctattatttagccttgactcttttcagcacaagtacttaaagttacgctattaccttctaaagtactaataattgaaagggaaccttatttcttgtctccagctcatatgtttttgttgtgtttctgcctgcttcagatccccagggcactggtcctactgatgtgttctcatgtcttatttctgttgcaacttttgggatgctagcttgccacatgatatctgtaatttctataccctatatcccaatcaattagataaatattctttaaacattcataaaaatcatataatccatgtaatgtttaaagatggtcacaaagggccatgtgccaggaattcttagtgacggtttctttatgacttttcttaattctagtagatcttatgggtttctgatctgagggcttggagaagcatttagtcataataaaaacataagggctttaaactgggtgcattggtttagattagcagcaggcattttgttctaccctctggggcttggatagacatgaaattgtatgtatgtatcagaatattattattaatatatgtaagggtctgagaaaaacagactttgaaacacttcttgactgaggcagatatttcagatgacatgagtttgagctattactgaataataaagggtttacaaatctaagactaaagctattgaaaaaatatttactttttgtggttacatctatatcaatacacagctaagtgttaatgttatatattatctgtaaaaggttaaaaagctgttttatcagatgtgaaaaagaaaactataagatatttgaaagttgtttgtaaactataaaaagtatttaaattttaattattattaataatgtgttatggtgatagattgttactgtcctcagtttaactttccttagtatcaagtataaacataattataaaaactaactgtgaccaggcatggtggctcatgcctgtaatcccagcaatttgggaggccgaggcgggtggatcacttgacgtcaggagttgaagaccaccctggccaacatggtgaaacaccatctctactaaaaatacaaaaattagccgggtgtggtggcaggcacctgtaatcccagctacttgggaggctgaggcagaattgcttgaacctggcaggcagaggttgcagtgagtcgagatcgcgccactgcactccagcctgggcgactgagcaagactctgtctcaaaaaaaaaaaaaaaaaaactaaagtagaatagtttcaagaatgaataaacctgaatttccaaggcaggtttggtattatcctactctaagtaaataaaccaatctagcatcaaaggacaatgccctttcgttttttgttttttatgagacgtgcaattaagaacctatttataaagtattcatagccattttcatggttttttttcaagtcaaggtaaaatttttgagctcatggcttaatgatggtgaatatttagtatcataatgtacagtttcttttatttcatcatggactatgcctagttaattatcatggtaaatacttactatatgtcaagacctgtgatctcatttaaaactcatatttgtcctattaagaaggtattgtctccacaatgtgaatctagaagcagacttaaagatgttaagagacttgcctaagattgtgtagctcctagtaagtggaagagcagttacacacccatatctttcagctcttaatcccttggtcattatggtatactgcctcttatcaaaattagatgactattatgattttcatcaatattgttgcttagggaatatgtttacactatgaggtcagaaattttcttctgacacagaccaggaagaatttgcattcagaaaagtgtatcagtcatgtttgcactcagctgtttataacaaaacacctgacaaaattatctgaataaacaaggaattttacttcacacaacaagaaatccaaacagcccagggctggtactattatgtaagacccaagcactctgtcttcctattctcctttcttagagtaagacattcatccccatcatcacagaatgcctgctgtagctgtaggcttgggtttgaactccaataagaaagaaaaaagaaaagggaaagacatatggtcataccagctatgttagctcactgtaatcagatacatagtagctctccctaaaccccaccctagattcctgcttatatttcagaggtcacactcacatcaaatgatcaccttacatacaaggtagaaaatgaagttgttttgttttgttgttattaaaatcagtgtggattcttttaataaagaccaaagtgggagagggaatattgcgtaggcattcagcagcaactgccacaaataaataggtattaaatactctggttaccaaaaggaaagaccaaggacccattcataacccccgatagctaaatatttagataatatttgtttccattaaatgactaagtaatatttcttggctgattagaatggaggatactggggaaggaggagtcaaagataattcacaacttatctaggttttagttggatattgagcctacagtgcagggaacataagaggtacaaggagagctggtttagggtgaaagaataaatttggtttgagctatattgaatttgatgtgccagcaaaaggaagtacaggagatgtcctgtcagcatctggaaatacagatctgaagcttgggagaggtgagaataaggattttattagtcattacttggtaattaaaatgggtagacaatggattatatgatcctggggtaatatagttaaaagaaggctaaagatgggaactttgagaaaatataatttaaaatcaggttagggaaaacaaagctgggaaaggagattaaaaagtaacactcagggacatagagtagaaaccctgagtggcaatatctaagaagtcattatgggaaattttcaagaagggaggggaaagaaaaaacctaaaaagataccactgactggtaaattaggatgttattggggaattttgttctggtgggtttttttttttttttttttttgagaacagttttagtacatgatagaatggcttaagagttgttgattctcttgaagaacatggtaaattcatttgttaagggcaaaagcataagctttgcagctacctgagatctctaaacctggggtttcattgcagcgctggcacttctatctctgaaaactgagaaatcgatagaagtaaattaagattgtttctcaaggagaagctgattactaatagacattgagttcccacaaagccaagccttagggaaggtcataattgactactggcaataattcttcctctgtaaattatccaggaaaaattattcacctcataaatttccttcatatcaagcgacagctggttcattagtaagtcttggcatacatgctaatggctaccctttcttcgactaccgctttttactttaagctgttcttgctatgtcatgtttcaaagacttccctgagtgagtctgtttctagatctatagaatggagaaaatgccttcttcacaggtccaaggtgaactttaaatgagatcacaggtcttgatacacagtaaatatttattgtcccttactcattctctcctaaggagtcttagccctataaacaaagcctgtattcctaaaccccacaaccagtggtgtgcccaactgtctgttcagtgaccacttggtaacttgaaatcagccataatgggagtatttatatcacggaaatcagaaaactccgtaaattggaattttttttcctcagaaagctagttgttaaacatttactgtaacagcactgcctatacccaccacagagaatgaaataattaggtgactaaactctatacagctatcaatgtatcttgtacactgatttgatacttcataatggaataatacttcagtatatagcccagataaagctaaatcattccattcattttgatcattaaacattcattgagttgcttctaaatgccaggcccagatatagataataagattactaaaatcaacaaaagtcattatcctctgggagtttataatctagtggggtgggtacattacaaatagatggctaaatagctggatagatgattgatacatggatggatggatggatggatggacaagggagaagtacacataataccacatgataaaactgtaataaaggcatgagtaaagtagttgaggaacattcgaagcagtgcttctctttgaaggagttaaggaagacttcacagaggaggtgacatcttaaactgtgccttagaagatgactagacctatttaatggagagggtgttgagtatggctcatcctacctaactgtacttccttctgactccagctatcacaaaggcgacctcataaggtttgggagaactaaataaaataatccacacatattatttacaacagtatgtttcacagggtatacaaataataattgtagctagtttaattactataccaaactgaagaggccatcaggcctgaggaccaacaagggagaaaattcagtgcctcagtctccagtgaaaattttatgtcctagactcctttccagactgaggcatgatgttcgttaggctcagctttactgcagactccttccttttgagctctgcagctatcagaaatctttcaagctggggtttcatttgcagaatattgtttacaagactaaatcttaaataagtcctcaaatgtctttggcctttgctcactgccctctcctcccaattttagaccattatcacataataccctctttagaagtcatagctaaacaaaattatctctgacaagtacattttttaatttttatgcaatttatttttatttattttttatacaattcagcattcagatcaggcactgataagagccttgggtaggacagagaaaaacatcatctggaagtagctcctcagagaaaaagtacctgcaattgtgttactatcaaagagcaacaactattttctttcgattatgacatgaaataaaaacaggatgacgaaaatgcacatggttatttaatgactgcagtgccagaattccctctgccctcttctttcctctacctcccctagattgataccaagagccctgcccagaacttcagcctaacttgtatcttccaaagattatgtttgccttagttttctttccccgctcctatcttttgattaactcagtatttccttgaatgtggtattcaggtatccatgtacttctcgatagcatgagacttgtttttcttcaaaattgggcttctatattatccagtattttgcaataattaattttttaattattgttttgtacaataaatggttatctggtgagatttattgaagacaagtgatatttaaggaagttcataatcctgcccccatcttttgtctgaagatcaaacaaccagagttcttgaggtgctttagcaaaatcagagttggaaatggccaaacctaagaacttcaaatgagtactggagaaaatgaaactgattttagaaattgtaatttatttttttaagtatatcattctaatatatcattctgacacttcaataatagccttcttttcaatagagctctgcagatacactgttactttccactaatgttagatatataggaagaacattaacttttccaggccacttaggaactctttagagtctggaacatcctgaagaataatcatttcctgtaaatttttctagttcatgatcttcttaatagtatgtacaaaacattaaaatgttgtccggaaaaacttctttactctcttccaagattttaatgatctttaatcggagcacagttttcagctaagatcgtattatccttctttgtttttgttccattaaagagaatggttaacaggccattcattgttcatccatcagctatattctaatacatgctaattatttaaaacattatgtattgtatagtgccaagacaacaccaaccatttcctaaataaataaatttacttactcacattcgtagctcattaccttggtataataacaatttagcttctctctcattgttgaagtatataacttttgtttatcatattttaggaaaagtaaaactacatttatccattttaaatgttgactgtagtattaagttgtttagtacttagatttctgggggtgggggttgagttgtatatgtgaatatgttatattctaaatatgttcaaaatgtattcttctgaaattttatttataaaaaatatttttcgtattctttctcactgtccagatttctcatttttaaaagcatatgtctatttgtaatagaaacctgagctaatcccagtggtaaacatgctcagtggcttagaagtcaacagagaaatacatttggtgcaagccttgagtagatagcagaatcatcattaaactggagcctttagctaatttctcttctttctttatataaactgttccattcagtgtcctatttaatgaccttctgctttaggcattggaaataagcctctgctatttgctaagcatattattatgtattttgaatatattattttgaatatatttttctcaaaaattcttaaaatggagtgtattcttatctccctagtaagaaggctaaacctcagagtttaagttaaatctttgacttttaggtgctaagagacacacaaagatgaggaagatactgtgctggccttcaggagtttgtagtctaatgggggtttgaaaattaaacatgaacacatttatatacacatgcacatatatatattatatatatatacacacacacacagagcccaatgacaagaggtcatgtgtgatgaattacacactatctcttgtcatagggctgtgtgtgaataaaaggcataaaacctttacactattataacgctgtgaaaaaaggcataaaactacagtatagggaatctttccttaaattttgcatatctaaaattttagctcagcaaattggatgatctgagaagtcttggataaagatatgcacagtgcacaccatgctaacctgtcttttaaaaactaaacaaattaaagcctttatgcacctatgaatcatagcaacaagactagacatcatgacagacctaaaaagacaaaggctagagtagacaaaatcagaatcctaactactgaaattgaaaagccaagtaagcagttaggtttcagatatgaaagaaaagcaaattggacaaaaaccaatcaggaaagctgggatacacgagtaccaggtggctttggatgtcaggataaggttctaagacaaatattaaaaatgaggcatgttctatgtcagccaagaagtgtcatatatttcctgctgagataaagatattattcatcctgcagtcgggaatcagtatttccctattaggtgatggaatatggatgaacctggccaaatggggaaggtgaagcctgaggacatactaggagtcagtggtaaagttgggtttaatattttaattttgttttataaacatattttctgaagcagatctcttggatatatgtaaaaataattatgtttttgtagcttagaatagtcttaatgtatttattaagtatttctagctaatattatttagctaaagatattcctgaaatttacataagccagtctttggctactgtttaatcatcatcatcatcatcattatctttgtcatcatttgttatcacttgttatgtgtcagatattgtgctaagtgctttacacgcgttatcttgcttaatccttgcagcaagccttggagataggcacaattattatccatattttaacagatgaaatactgagactcatagaagcaattgatccaagatcacaaacctaataatctatgtagccagaattcaaatgattcagtcccattccagagcattggctcttaatgattacattattgcccttactactgctagagttaaaacttacagttttccatttgaatttagatgatataataatcccatgagcaaaaacaaataagaaatatattaccaaaactgccttcatattcaataataaattactttaaaagaaagaatagcagctacttttcttttttattataaattataagaatcagagaaaagtctcccatacggagtatagtatctattgaacaattttatagctttgaaaaatttcttaaaactttgatttttgtatgaataaatgcccaaaaaacatataagtaaaatgaaagccttccatatataccttaccttgagatcacatttactttcaataaattttgtgaaaatatgtatagatatatcatttattgtattatatagtatacaatatattattgtatagtgtacatattatatatattatatagacagatataacatggttaatgttgacaccattcatttaaatgctattctaggcaatggctttcaacattgtcatttaaggcaaaatgtttggtattttaaaatgactttatttgaaaaataatattatgatctaaattgtctttgaataaatccactgtacattaataatgtttcttttaaaattaaaccctatggttctatttaaatagatatttcctgggaaaaggcagcaatttttagaagaatttaattgtatgcttttcaataattgagagtttatctaacaagatagaaagttaaagtggactaagaaaggccaattctcacgtaatttgaatatatgttgctaggttaatggatttgactaaaattttgtggagccttagaaataatttctttacgtttgaagaagagtcaattattaaaaatggatatctagatactgagaggttttgggagaaaacaatcaacagatcacttatatcggatctactgtttatgctctgttgccactcaatttatcttggccaaaatgtttatatctatctaatacttgcaatgaattgtcattcgtgggggattgtttattaagtaattattctttaagacatagcaagtggttgataaaaaataatcatctttctaaggctttatgaaatttgctagtatctgtgattagaaaattctcctttgcaaaattaactagataataatgtttcagcattaagtttgaagtgcatctaaacaaataaaaatcaattagcagataatctcttaacccaatagtagtcatatttgatgtttatagtaagaatactgttacatcaccaagttgtaataatgcagtaataatacaggctacatttacttacattatgccagataccacatacgtcttagttctaggccttgcaaaaaaagatattattatccatttttttttaagaagccttttacaggttaaatgatctgctcaaatttactcaactagtgagagtttttcttacctcaggtttgcagactccaaagtctatcctttttacatctcaacaagaggactcttagcaaatgattttttgttgtcaaaataaagttaaattttgtccattagtttttgcattaaatgtattttatgagactaggtcattaacctaaagcatttacgatggtttttaatttaccagaatatttgaacacccaagaataccctgcaaccctggctgtgccagttaactatctgactatttcaattccaggaagtttgaactattgtaaataataatgactttttctagtatttctaggattcatcaaaatccagcaaccactctgaaattaaactttctcttttctctcggcttttctaaaaagagttaatggtttaataattagattttatattatctctaggttttcagtgaagcataatggattaattgatggctactagaatttattaaaaaataaaaaaaattctacttcctcatattaagccaaatgtttatttcccagatcttacctaaatgttctttcctgaggccagtgctgttttgaaactattttaatggccttcactggggtgtggtaaaaacattctaattactttgctaaaaacaaaggtttcatataaattgaatttttcttttaggataattgccattcacttttgttttatatgcaactgagtgggattttgcagtttcctctgtggacaattaaagtgatgaaataggagaaagctaataattgctttgtgtggtaatactgacaacttctgcgtatttgtcaatctgtgttaacagtatcgatcaggatgggatcctcatagaggggcagataatgtttctactaaatcttcggacagtgatgtaagtgatatatctgcggtttcaaggactagtagtgcttctcgtttcagcagcacaagctacatgtctgtccaatcagaacgcccaggaggaaacaagaaaatcaggtaaggggatttcaacaacaaacttctctaaatatgttttagaaggtctttatgtttcccggatgaacataaaattatttatttctaacaggttaatatatattttaaagccaggggagcttaacttcagtacatactactttttaatatattttaatccacatttcagacttcctgcacagaagaaaatgttatgaaactatggataattttgcttactacatcactggaaataatatcttttttcatgtttgtaatttaaaaattaagacctcttatatctttattgaaataaaagtgatggctgagacttgaatttttcatgttccaaggaatatgaaaaataatatattttgttattagaaaacataagaatgttactttttcagtaggatgctttcctatcctcttgaaatttttatatatgcatagaaaaagtcctcatcttctcaagaaaatttatacatatagtatataagttagtataatttgcatttcttacttgtcctatagattttatagatgcctaagctaaattttgttttactcttattggattaaaaattttataacagggagatcacaacttttaccttttttcatgtaattttgtaaaaggaaaatatgatttaaaaactattacaattaagtgctatttatacagtgcttctctagtatacactgaagtaagttttcaacatttaaaagatataatttttacttatgttttgatagtttttattacctttctgtttaatttcataagtgttttttcttgactttctttttttgtgtgtttatttgcatgccttcaatttctgttgctttcaaaagaccaaagggaatagaagagggagggaaagaaggggataagcatgaagagatagttcatgagaaggaagaggtaaaggaagaaagaattaatgagaatgagaaagggaaagagattgccaaaacgtgtaataaggagaaaaacagagaatcaggagacgaggaaaaaacacaagatatacacgagcaagggaaagaaaaagaacagtggaataaagaggatttgcaaaggagattctcacaagatgataccaggtaaaatatgttatttgtaggcatttcccattagtaatgtagtcttttttaccattcctaaaaattattttgccatttccatttgctttattttcttgtgttttatctatttagcttctaatattactaattaatatgttggcaaactattatcaaatagattgatttattaaacagtcttgaatttgtatccactagctctgagagtctgatttatttggttaccaagttcgttatgagtagctgaatccaatgtaaatttccctgtgtctcttttaacatgaattactgtatatcttctttatctgtaaggtctaataaagatcattgaaaagagaaacttgaaaattctttaccaatattgaaaactgcttcagacaaaaataaggcagagttctttaaaattaacttctgaagtggctgaaaaaaattgagcttactttacaagaaatattatttcctggaaacaaacttcaaaaatgaatgagaaaacaggtagcaaatagtagactttattctggctctggttcccttgcttcttcttagttttctggtaggttctagtgcagtttgagtcctgcagaagattacaaagcaggagcaatgttttttaatactctgaaaagaaagaatagatgccttagggtttattagaaggcaagtgttggttatgcctttcttaaactcaatccattagataaacttctggagagggaactttgaacagggagaagggcagggaaaaaatacaggcagcatggcataaaaacaactatattttaattttcatagcacaagtcagtaagtaagtatgaagctatctttacagtattatatatattacatacagtcaaattagcacgaatgtgcagtcagactttatccttctgcttgaggatatgacgttattctaattacatttatatgagactgaaaattgtaaattatgtacattttggagggatggagttttctagtagtccagaatttgattttgtgttagtacaaagcctgctcaataaaagcacgccttatttataagcaagattttgccttattatatctaagcccaatctaaaattgtgcttttctcacttttctcacagtgagacagatattcgggatagaactctacccattgagtatacaattcagtgatttagccgatgtcccttcccttgttatcttagatatatttaactgtatttgtgctctatgaaagtttctgtataacaggcattaaacataaaaatgaatcttaaggcatattttattatttgaatctaaattagtaatttcaaatctgtctttggtatttaacttttgataattacattggtttactaataaagatgaccatttttctgatttgttgggcataggataatttcatcactaattcacagagaaaagctttccaaggtgtccttggaaagatacatagagtttcctttcttccaggagcaaagaaaagaatgagtctctaatgtgttttctacatactgtatacatgagaacacatgagcccattggtgtttgcctggagcccagatcccacgctgccatacctggcttgctaggcagagattcagagaagactataaccttaagtttctggtttttaaatagtacttgcttcattattttttcaaaaaaagagcacattatttttcaaggaaaagggaaagatggtacattctagaaatgtggttgatcaaagcactacacttagcttaagtaactgtgtaatacttctggaactgtaaactagaggaggccaggttgatctctgtagggaacatatatcctggaacatgccaagaagtatcaacggcaattgcttataagaaaatgttggggccgggtgcgatggctcacgcctgtaatcccagcactttgggagtctgaggtgggaggatcacgaggtcaggagatcaagaccatcctggccaacgtggtgaaaccccatctctactaaaagtacaaaaattagctgggcgtggtggtgtgcgcccatagtcccagctactcgggaggctgaggtgggagaatcgcttgaacccaggaggtggaggttgcagtgagccgagatcatgccactgcaatccagcctggtgacagagcgagactccatccgccccccaccaaaaaaaaaaaaagaaaaagaaaaagaaaatgttggtagcactcattaatcatttcaacataggcttttgaatttgcttttacttcttagaataaatctcagtctttattgtgagagaaaatatatctgagtattccaagcatcattttgttttggtagttgataaacacaatcacagattgtttaaacattaataacaacttatgttcttatacaacattattggaaataatcttattctatactacaggctgaatattccgtatctgaaatgtttgagaccagaagtgtttcagagttcggatttttttcagattttggaatttttacatatatataatgagatatattgaggataggatccacgtgtaaacactaaattcatttatgttttatagacaccttatacacatagcctgaaggtaattttatcccatatttttaataattttgtgaatgaaacaaagtttgtctgcattgaatgatcagaagcaagcaaagacatctgtctcagtcactcatgtgcacagtctgtggttgtttggcatcatatcatttctgactctgaatttctatgctcccaaccagtagtcactttcttgcacttattaacacataagtacttaacagtaaaaaatatgacaaactattaatacagtgaaaaggtaatgtgttcagggaactaagcagcatagtagcatcaccagaacacctatatcagcagttaagcaatagcaaaaaaaaaaaaaacaatgacaagctttcagtttctccctacaatgttgtgttttgatttaaaggttactgtgcattgtggcactcagaaagttttggattttggagcagttaggattttggattttcaaattagggaatgctcaacctatatatgattgacattttatatcttttatttgaaatctaagttttatgaagcatggtccaaaagtaattgcggcttttgccattacttttaatggccattacttttaatgccattaattttaatggcagaagccacaactacttttacaccaacctaatatgaaggaaaaaaaaatttacctcagagtttaacatttatagcaatgctagtacttacaattaacacagtaactaaaataaacagaagccattataattgctattttcgttaattagatctaattgtatgatacagatcttactgcatgattatgttcattttatagtaagtcacatttagtaagtctactgaatgtaaaagtagaaatgaatagcaaaaagtaagttcaaaaatagtttgttaaatgtttgaatataatatttttcctaagttaattaatgagtaatatatttatacttagctatatttacacacacatcaaaaataaaaatttaaaaagtttaatgaaattaaacatgttaaaatttctaagcctgagagtgatgcagtttcttagccatgtgtggatggatgtttgaggatagttccatattaaaatgtcatcgggatggcctcaacaaattcataagaatatttgatgaaatattcagagagaggcaatcttaagtaatttgtaatggaagatagaaaaaacaaatactgaaaagcatagtattgtcaaaagcaacaatgttggtaattttgtgttcaaactaaaaatcaagaaattatttctctatacacttatggttctcaggcatatctataaatgctatggaattatcattgctcttttttaagagaattgctctttttgagatagagacttttttaaggaaaaatttggggcatcagttcaaattttcatgaataactgattttaagagacttagccatttcaattatctagcaaaagatctcataatctttagaaggacaagcagaataattgttaatgaaacatttattcaaagtcactgctgctaacatattctagatcagagttagtgtgaaaacagattacatagctatgtgatataacttgatatatacagtctatttatgcctatattatggaattttaaaggggaagcagaggtcttttgaaaatagttgtgattaggactctaaaataccagcattgtcatcctgactgttgtgtacacctatctattttgtctatctaggctttttagcttgttaaacagaggaatggatttttcaatgattcacgcacctttccatagcttagatgatagtatgcaacaaacaggaaagtgagcattgcctgttattctgatgatttgcctttattatcataaatttgaggtaattggttctgtgactgaccactggtacaacaaacagctgaacataagtttctactatttggcagatgtttccagacagtatttaatattccattccaatattccatcaagcttagttttttgttttgttttgtttttaattttctggaagtgtgtttcagtgccaactcatcacagagggtatgatgggctgtgctcctccaccaagtattacctgtggcttgtattttcttttttgttgttgttttcttctttatcaccaaggctatcttctatttattaccaatgaaaaccttataagcccaaataacttctactctgttttatgattgtgcataacactcaactgggaactttttgaaagtacttgaacatcactcctaaagttgtgattctgcatttttaaaacaccacaggtgattatgatgccagtggtgtgtaggtgctattcctcctctcttttgggttgcttgtatttcctactgaaatttcagttcagcttgtcaattcagggggaaaatttctgggattttgatagagattgtgttcagttagatcaatttcaggattgttgccattttaagaatattaagtcttctaatccatgagcacaaaatgttgttccatttattttttctttatttttctgccccatatgatcggcagaaaacatttattttttctttactttctttttttttttgagacagcatctcactgtgttgcccaggctggagtacagtggtgcaatcatggctcactgcagcctctgtctccccaggctcaggtgatcctcccacctcagcctcctgaatagttgtgactacagggtcacgccatcacacccagctaattttttaaaaattttttgtagcgacggggtttggccatgttgcctgggctggtttcgaacccctgggctcaagcaatcctccctactcagcctcccaaagggctgggattatgggtgtaagccaccatacccagcttctttattttcttgcaatgatgttttgtagttttcagtatatacatcttttacttcttttgttaaatttattctgagtattttgtttagatgctattgtaaatggaattgtttcattactttcatttttaattgttcattgctagtgtatagaaatacaattaatttttgtatgttgatcttatatccttgctgtactcattttttagctgtaatagttttttgttgattccttagaattttctatataggagatcatgtcacctgcatttaaagatagttttactttctctttcaatctgaatcccttttatttctttttcttgcctcatgaatctcctctgctatgttggttaacttatggctagaacctcctctactatgttgggtagaagaggctcatggaaagttcttaaagaaacagcaatagccatatagaattacttttacattagctatccaagcatttttgaggatattgtttcttatgctactcatccattttagaatagtctaggtaaaactttaagattttattattatctctcttaaagaacggatatagctgccttactgataagaaaacaatgtagcccattgtattttcttttttatctagtctgttggcaagttcaagtgaaatgccaaaaacatactaatcccattcaatttcctgttatatatatattatatattatattatatatgtaatatataatatatatgtattatatatgtaatatatattatatatgtaatatatatcatattgtatatgttatatattatatgtaatatattatatatgtgatatattatatattatatagtatatatgatatattatatagtatatatgatatattatatagtatatgttatatatgatatattacatatgtaatatatgttatatattatattatatattacatatgtaatatatgttatatattatattatatatgtaatatataatattgcatatattatatatgtaatatatattttacatatatatatttgagacagggtctcactctgctgcccatgctggagtgcagtggcacaatctcggctcgctgcaacttccgtcacccgggttcaaacagttctcctgcctcagcctcccaagtagctgagattacaggcatgtgccaccatgcccagccaatttttatatttttagtagagacagcattttgccatgttgcccaggggctggtctcaaactcctgacttcaagtgatccacccgcctcggcctcccaaagtgctgggattacaggcatgagccaccgtgcccggccttcttggactatattaattctactatattagacataataattgaaattttttaccattgtctattttttattgtacacatttgaggtgtaaaatgtgatgttttgatatgcttattttgagatacatatagatacacacacacacacatatatatacacacacatagcatttactgtagtcaagcaacttaacatacccattgtctcatatagttacctttctttcttttattttgtgtgtgttaggagtacctaaaatctactctcttgtttgcctcctttttgaggatttgtttttctacttctattttattacaactacaagttatttaactttttgttacataactgaaattatgtatgctgctaaatttagttagcagtttttatattttatcaggcaaactttatttagaatttgatctcattgccaatctcttcttgaaacattttgtctgccctcttggcttttatgattgtctgttagttctgcatacactctggccacctctgtcttctttgtgagctttctatatgtcctccatgttgacattttccaggatcccatcctgggccctcttttcttcactatctacacgtattatcttaatgcttcatggcttcaatgcttcatggcttcaagtagcatgtatgtattgataacttccaaatctatacttccagcccagatctccctcctaattatctgccagatctgtcctcctgggttctgcacatcttcctgtatgtcccaggggcatgctaagctcagcatgtaaaattaaattcattatacccctcaccaaaccagcagccaaaataaataacttactcctccttctatacactcagtctcagtgcatggcctgttatctttgcacctgctcaaaccagaaacctgggcatcactcttgattagttcttctccactgggcacaatttcttccctccattcaccaagtcttgttgattctaatgcttaattgcctctgaaatatgtttatttctccataaccccatttctccttccataacttgagatattatctctcatggagattagtttaataggaaattcttatcttaaaaaataacttataaatataaactgtattagtccattttcatactgctatgaagaaatacctgagactggataatttataaagaaaaagaggtttaattgactcatagttccacatgcctggggaggcctcacaatcatggaggaagttcagtgaaggaggagaaaggcacatcttacacggcagcagtcaagagaccatgtgcaagggaaatgccctttataaaaccatcagatctcatgagatttattcactatcacgagagcagcatgggaaaaacccgtccccatgattcaattacctcccacccaatccctccaatgacacatggggattatgggagctatgattcaaaatgaggtttgggtggtgacacagccaaaccatataacaagctcattaggataatagcataaaatatgagtagtcagtttctctgaagtagttaatttgtgaaaacatcagagaaaaagatctctgctttggtaaataggtaaacaatgtggtatatccatacaatggaatattattcagctgtaaaaaggattgaaccactgattcatactacaacatggatgaagcttgcaaaacttacgctaagtaaaagaagaaaggcacaaaaggccatatattgtattatttcatttatatgaaatgtccagaataggaaaatccttaaaaaaaaagtagattacttgttgccaggggttaaggggaaaggagactggagaatgactactaatagatacagaattcatttttggggtgatgaaatgttgtcaaaatagatagtggtgatagtcacacaactttgtgaatgttctaaaagctactgaatcatatactttaaaagggtgtgttttatcacctgtgaattatatgattttaaatgccaaaaaatgtctccagaaaaaagtgagggaaggagaatctatagtctatgttgcttcttctataaatatgactttagaggtgataatatgcaaacaatattttgtttagggtttagtttgtcaagcatattttcttttattctaatactccttctgagccacctttccctaaaatattcatcttttttctatttttttcatctgtgcgtatatttttaaatttccagagtgttgaagatgaataaaacacagaccttatgctcaagaaaaggtgattttttttttcctttctgttactgtccaaaatttattctttggacataaatataatcattggcctcaaactgtgaactggctacatattgaagattctcaattaataattaaatatattattctcaaaaatttaggaaaattactaggttaaatgttgatacgccatcatattattttcctgtgtggtaaacttgagtgtactcatgacttcacagtcactatatgggaccctgcaagtgacaaatttgaggctaggtaacatacatggtctgaagagaaggtctatctgaaggtagaggactgagaaggcaaacctactagagtaagaacctgaagatggaggaggagatgggatcagaaacatagctggataaactggcttgaaaaaggaaaaacaaatatgaaaatagataagttattagataaggagttgggaagttggctaatactgcctgatggccttaattttctcaatcacataagaagtaagaatataagagtttaaaagttgagttgggggtttgaagatttggaataactactgaagaaaatatgagaagtagcttacaatggacaaattaaagggttgttgaatagttctgcaggttggagacaaacagtttcaagagacaccagcatgagagagcagtgtgatctttctcactagcactgagataggtaaagtgtagaaacagttaagtcacactatagcatttattgaggagtgggagttttgatggatggggttgttggaaaaatagcagtagaaagaaactgagagtgcttgtataaatgtcagtgctaaataagaaggaagacaagttcatgtgggaactgatgaagtaggataaaacagatgaaatccaagaattggaaaattatatgatatagtaaaaatagggttcggggaggtaagaggttttagttataatatgtctttgaggcctgtgtgatggctcatgcctgtaatccgagcactttggaaggccaaggcagttaaatagcttgactgcaggaatttgagaccagcctcttcaaaaaatacaaaaattagccaggcacagtggtgcacacctgtggtctgctacttgggaggctgagatgggaggatccctttggctagtgaggcaaaggctgcagtgagctgagatcacaccactgcactccagcctggttgacagagtgagaccctgtctcaagaaaaaaaaaaaaaagagagaacatgtttttgaaatgtaagattttatgtagatgctattctattagttgaaatattatatgacacagcattggagtgaatagagtgtaatggaagagaagataaatatgaagataactggatttatgtaagtttgggataattgggcggttggttaggtttttgtaacggctatttaaatcctttaggattgtggtaaaattgagaattgaagaaaagtctaagccagctctcaaggacttcagtaaatgaaggagtgaccattagataccagaaagggaataaaaggggttgggtgtcgggaggggcagaggtataagttagcatagccagttgtcataaactgcaaagaaatttaaacttctaaataaaagtggaaggtaaatattcaagaaaaagtatcaactagccagaaatattacaacctaggaagaaggataagtatttgttactagaaagaacctcaggggaaacagcatgttcaagaaagtaccaggttttagttaagacaagataaaggttggtattgcattgtgcatagtgaaaagggttccacttgctattggtgtcaccacactttcagggtgatcatttctactaactgatattatttctaattcaataccatatctctcttcattgatatgaaattggacatcagtgttaattaaaaaaaaaagttttaggacagagtctcattttgtcatccaggctaaagtgtaatggtgctatcatagctcacttcaaccttgaccttctgggctcaagcaatcctcctacctcagtctcccaagtaactggtactatacaggtacatgccaccatgcctggctaattttttaaaaaaatttagaaggctgggcatggtggctcacacctgtaatcccagcactttgggaggccgaggtgggcagatcatgagctcaggagatcgagaccatcctggctaacatggtgaaaccccatctccactaaaaatacaaaaaaatttagctgggcatggtggcacgcaccagtagtcccagctactcgggaggctgaggcaggagaatcgcttgaactgggaggcggaggttgcagtgagccaagattgtgccactgcactccagcctgggtgacagagaagactctgccacaaaaaaaaaaaaaaaaaaaaaaaaaaaagagaaagagaaaagaaatgaaatgaaaagaaatgaaaaaatttaagtagagacaatgtctcactatgttacctacccagacttgtcttgaactcctggccacagacagtcctctcactgatgcctcccagagtgttgggattataggcatgagccccccagcctaaaattcattctcatgtcttacataagttttaagagacttttacagttttactttgtaatatagttagttagtaacttctatttatttgtatttctgtgataactggttattctatccttattcagagatgcctgcacagattaatttttactgattaatttcattatagacaaaataataatttagagttatatacattaaaaatgttcattatcattgattaatatattcaacttttgttttatggcattactactattgattaatttgcaggtaaatattatttctattaacttgtctgctatagggataaaatgcatttctatgctcttttcacatttaatttctaacatttttcccactgattatacattaaggagtaaaatgaatttagtatgaaagtagagaaatcatgaaattggaataaattctactgtatgaaataattacagtagaaaaaaatgctgcagtagcttccatcacattcaatatttatttttaaaagcaaataaggacaattaatctatagctgttattcaaactaaatgcagtattctgaccagtgattccctcataatcatgtttatccctcatgataagcaaatttaacatacagaagttcgaattttatagatatagtaaaagaaaaagtttgaaataaaataactttcatgcatgagtattattgttagatgccataacatcagtatagtgtggtactatagtatgactttattttcaaattctgattctccatacagaaaaaatggaatctaatcttcaggatacaaaagtgaaaaaaaaaatccaagaacacctggcctgagactttaggattttaaggaagaaacaattccagtctttattttttagccatatcttgacttcaaccctttgcacttctccttgacccttctctttccaggatcttgtctttgttccttgcacgtatgttcacgttgactcttctacctgaaatgtggcttctggtttctttttgagtaaagtacctactcatccttcaccactcaactcacatgtgaattcttccatgacgtaccttctcttctcttcacagcttatatataatgttcttttaaaataatagtttctcttgtgatacccattttctcccctgtgatagttttttaagtatatatttaatctatcatggttgattagttgagtatagtatatctatcatttttatctttttatttttctgcctcccagtatctacaatatttcatacatagtagggactcaataaaactttgtatatgaataaattagattgcaacaaaacagtgaaagtttacacatgtgaagagctccaaaggaatagagcttccaacatagtacttctaacatagtgcaatatccaatatgctagtcacagtcttctttgacaaaagtttttaaatagtccaggacaggctggtattggtggctcacgcatgtaatcctagctctttgggaggccaaggcaagaggattgcttgagcccagcagttcaagaccatcctgggcaacacagcaagactccatctctacaaaaactttaaaaaaattaccctgtgatggcacatgccaaggctgagggaggaggatagcttgagctcagaagttcaagcctgcagttagccatgatcaaaccgttgcattccagtctgggcaacagagagagatcctgtctcaataaataataaataaatagtccaggtggtctttcccctgccccccccccacaatggaaataaactactatttcagaaatcagtggaaattacttcataataatgtatttcatggctcatatgtattccatttaggaacaatttggttggttggttggttgatttactgatatatgatgaatagtcatttccctcatcttttcatctttcaaaagaattctctttacacttttcttttggggcatattcaaagattggcatgagtttgcttaatgtttaaattctaatggtatcttttgttattttttcttttttttatttaagagacaagggtcttgttttatcatccaggctgtatcatatctcactgcatgatcatatctcactgcatgatcatatgattactgcatgccatatgatatggcatgatcatatctcactgcagcctccaaattcttggctcaagagatcttcctgcctcagcctcccaagtagctaggactacaggcatgcaccaccacacctggctattttttttttaattttcatttctgtagagatgggattttgctgcgtgcccaggctggtctcaaactcctgtcctcaaatgatccttccaccttggccccccagagtgcttggattacaggcataagccaccatacccagccttttgttaccttttcttatggttttctcccactcttgttagatttcatgcaggatttttagatataatgtaattatcatttggagatggcaaaaataagaaaatttgtagaattagtcttctgggactttctatgaaaatattttgagtagatatatagttgtctgaagaccactatgtattttctagatagtctattatttactcagctttcttttactatttctgtataccacagagtatgaattgctaccttatatggtacacctgtcatatatagagacttagagttctgatctggcaccttgaggattagactggcttgctttgctaagctgtgaatgagaacttgatgccatgaacactgactcatagtaagcatacaatgagtcttcatcacttttcatcatccacatttttagtataagaaataatgctgcctgtaatcccagcactttgggaggccgaggcggacagatcaataggtcaggagatcgagaccatcttggctaacatggtgaaaccctgtctctactaaaaatacaaaaaattagccgggcgtggtggtgagcacctgtagacccagctactccggaggccgaggcaggagaatggcatgaacctgggaggtggagcttgcagtgagccgagatggcaccattgcactccagcctgggcgacagagtgagactctgtctcaaaaaaaaaaaaaaaaaaaaagaaataatgctctaagtcccccaaaaacatgcatgagaggtaatatagcataatgattaaaagttagctctggattcagacagaacttgattgagtccttgttctgccagtttctaacaatataaacttgggaaaataaaagccactctcttcacatactggggataataatagtaatttttttagagggttgtcatgagaactcaacgcagtaatgccctcaaggcacttaacactttctggcacatgacaagcatttcataaatagtagagatgggtttaaaaaaagaaaggaatcggaaagaggaaaagtaaatttataaaattctcacttttttagctttttagaactgcatattccatagaaactttcctcacacttttccacatgacaattcagaataggatagatccattttgcatttcatacaagataaaatattttctgaagtaccaaaagatttcattataatttcacaaagtaatagggtagagattgtggacaatgtttataaggtttgtttcatagtttgatatggttgacctttagtggttatggaattaaaattattttatttcttaaattgccttcattttattcagcaaataatttttaacatctatgtgctagaccctgtgccaaaatagggaaaatagttgttaacaaaacctatccctttcctcaaagagcttattttctagaggggagatggataagtgtacaaatgattacaatatagaataaaaagtataaaaagtaattagattgatttgaaaataatagttcccattggtaaagcattttataagccacttaaatttcacttaaagctctctttgaagctcagattgatggaaaactgatgttataagaggtgatctaaattgcccagtattacataagtgtcaaagtagtgataaaaattataccgtatgtaaccaaagttcagggttccttccacttcactgcagaataccttttgaagacataaactgtgacaagaaaagataagtgaaactctttcagccttatataaggcagaaaaacattctcaaaagaaaatctataatttcttgctgcctctaaccattaaaaagtctttttctgaattaatagcttaagaacatatttgagaagcttaaacagtttttcttatccttgatccaaaccaagcataaggtttttaaactgtaaaaaatacagtaattaaaacattacatattattttgcacatgagtcccatgggttctcttgttaagtctttttaaaatattccagctatgtgaatctgagaggacatttagctaaaatcagtcaacaagataagaatatgagctatgaatacttagaaatataaaattgaatcttttaaatcagtgcttttcaagtgtattttcagaaagttaatcccctgcactgatgctttaaaaaaattattccactatcaaataaatttgggaactactacacatacagtccttctcatcaacattcacagcatacctgaacactctgagatgcactataataaagttgtatttaaaccagcattttccaaactttgtttatagtggaactattttagtgtaatactttcagagtcattcagggaatgtgcttaaaactcattgacatgctttaattttccatttcaaactttggcctctattctttcagtaaaataaatatttttattcttgttgagtttaagcataaaattatggtacaaaatatggggttgtctagaaaaaactcactgtagggattgatattatctctaaaaaagctgacagatggaactagcaaatgaattgtaaaatcaagtaaggattaacaaatccagtaaagaggaaaaatgttatccaaggaatacaagatgagatttatctctcaagcaatgacactaatagagggaatataaaaatagtttctatagttcaataaatattatgagaattgatcatttttgctgacttcccaaatatattttaaaaattcagtctgtctgttgtttggggaatcacttcaaacaaagcagttaagccacagtataaagagatggaattgacaagtggctcattttctttttgtgcgtttgtttgtttttgagacagagtctcactctgtcatccaggctggagtgcagtggtgcgatctcagctcactgcaacctctgcctcacaggttcaagtgattctcctgcctcagcctctccagtagctgggactacaggtgcctgccaccacgtccggctactttttgtatttttaatagagatggggtttcaccgtgttggccaggatggtctccatctcttgaccgcgtgatccacctgcctcagcctaccaaactgctgggattacaggcatgagccaccgcacccggcctcccattggctatctgtctgtctttttctatgcttccaacaatacgttggcttggaaacattagctgtaataaaggaggttacagctctagaactcccttttatgtcatatatacatgtgtgcatgcatgcatatgtgtgtctatgtatacatgtgtatataccatgctctaatctagcgcatgcttagaagactctctcccagtttccctctttatgaattgctctatcctattcttgccataatgtctgtttatttctctcctcctcattttcatttccaggttggttttacattgttatttaatgattatgagtccattattcccatatctaatatttcaacacatcattaaagtttcctatttccactattaattggaatataccctcttcattaaaagaattaattttacatattacacaaaatgagcaaattcccttatatttgtcaaataaaatattcaaggtcaatcaatgtaataacgagtgaatgttataaggagatatttagagacttctgttaagataaaatattgctacctcatttcctgttatactttcagagtcttcaccattttattttaatcatgattttaacaaataataatgttgatatctcatttgtagggtgcttttctggctaaaaactgattttatagctcatgcatatgtaatatatgtatatatttatgtataacatatggcattcctatactatatagatatatttctatataatacctacatacgtatatgatatatacatacatacatgatatatgtatgtgtcatgggatgttaaccgtaaacttgagagactgacagaccagattttattatttacattctgagatgaggattctcctggtttaagattctgttgctgctctaactaaataaatttagaatttaggttcaatctgtataaatgattataactacaaaagaaaaagaacttgtgtttcaggcatgcttctttcagagaacaatatttagggcatactgaaattttaggttcatgggagcaaagtcttcatctgttgtgagcactgctgtatccccagtgcctagaacactgcctagcacagcacaggtcctcagcaaatacctgttgaaggatgaatgagtccctatttcagtcgtttttaaaactgcagtttttcattaaaactactgaactcagacaataaatgagaaagataattctaaaaatcaaattttaaatatcaaagtattaggtaaaatttagtgcccttttcattaatcctttaactgttatgaaatataatcatcatgttccttttgttcatacttttctgctaatggttcattcttaaaattgtaacatagtacttctctttcataattagattataatatccagaaaaccataggccatcattggaaaggactttagaagttaactatctagtaccctgaactaaactaggactcttcctatgtcagtggttgtcaaatcaggctcataaacaaaacactgggggagctttttaaaaacataaattttctggccttgacatgagaattctattccagtttgtatctaaatgtgatgaatgctctaacgctatacgatatcactaatagttgattgtccaatctgcttgaacagttgagagccctctaccttatgaggcagttcatattcttggacatttgtaattattataaagatttttcccaattgggccaaatcctacctgcctataacttctttaaaggagactgctctttacttgggagatgattagaaagatattaattttaaaattatcttttgattgagcatatatcttacgcatttctgtatttatgatatgtttcacggttcttaaaacatgaaaacaggactggaagaaagaattgcatcagggactatcattttggaattggctctagttatgctttaacccactgactatatatataaagtaactagtggattacatacatatatatatcatatatatacatataatatgtacatatagttctacttttattagtataattcttcattttttcatagagcttttatgctccagccctagactgctgatcccaaattatgttttttttcaaatagaacaggctactccccctatcaaattttgctgagtgccacaagaagatatgtaaacaattcagttatttttttaaatccagttttcagtctttctaccacattataaggttagataatggattaatggcatacaaaaaaataaccacaaataaggaaactgtcttttcataatctattttgtagatattttcttttaatgtgggttgaatagttaaaatgaatacatttagataattaaagacctgaatttgtctctgacaaataaattgttctgatattagaattcctaatttttgtcaatgttatttgaactgaaaagtaattttcatgttctctaaatgtgtttaaaatacttttactgttattttaaaattattatttacctttaagataaaaacaacacctaagagaaattctattttggcattttaaataatattcatttctgcattaagggtttgtcatattccatttttatctgcatttcacttgctatatactagtttctcgatttgtggttattacacaatttggtattaaatcagtacataatgcattcatcttgtattgaaagattggtttgcctttagtgcaatttaaaaacattgtcagtttgttgttactatatggaaacacagaaaaaaggaagatgacagttaaagaagagaacaaaaagatgttgaaaggattaggtactactattttccttaaggaatatataaattatactataaagcattttattaatctttccattgtattaaataacagtagtatttaaacccattagaaatttgttcgtaaatgttaatcattaatatttctgttagccaaagtaagattctaggaactacatcactgactttgaaaaatctggcaattgcctttttttttgtattgatggattagatattcatgtcttaattattagcatagttgctgcagaaatgacagattaaaatatcaatatgcttacagtatttttattcaatttttataatcatttaagtttttcatctacattaatgtataagctttaataactaattttttaatttttaagctttaataacttttcaagcttacattgaaggattgcaaatatttaactctaataaatataagaacacgtgcaagtcaatatttctttgtaaattgaaaataactagatgcattgtctcagaatattactgcataatagtttataataattattctgtagtaacaaaatgtaagagtactgatctgaagcttaagattataaatgtatttcagtttgcattcaatttattataaaccctaaaatgaaatgttaataatgttgattaaattcttaaactttcagcaaaataaattgcataggaataacagctgcctttcgcttttttaaatttcagaaatagttgtttattcaatgaggcgttttgttcattaagtgtagtttcttcagtgctagcttgacaatagcatgcttgatgtctttactgaatcattaaatatttatggttctagtatttgcatacttataatgagaattacatgcagtaaaacgatctttgaaatggttcagtgaggagggaaggattttttttttaccatttattataaactaaatctttaattatttttaacaatatgggaacacttacttagtaaatctggcattagccaactagaagtaaactgactagaatttttattaatcatgttttaccagaaataggaaagtgaacatagaaactgcctacatcaagataacggatttcttcttaaggcaactttcacagaattttctccagaccatattacatttaatttcctgggactcctacagttacagtgatatagtagtggactggggaactcaaacttaaagacctaaaggggccaagcaggtaatataagtgattgaagtaagtcaggcttaagaacttggtagtgttgggaatggtggtgagctggagaatgtatgcacccattaaagggggaaagtgctgttccccttaagctagttattgacatgcagcagtattgacagatctgctgtttcaggagatcagaaaccctaattcttatgttatctttgtaaacaactcttttggccaaagagagtatatcagtgggccagatctaatggatgggccaccagtttgcagctacagtagtaattgttggaatgatgatcctcaatgacaaaaattgctgaacaatcaaaaagggaataaatcatgttcttcattttgttatttctaagtcagaaactgctcatatgttttagaacagtctttagtaatatgaataaaagttaaccagaagattgcatttctaaagtattcctgttaatgaaggtttggtggttaataatttcactgtactcatgtgtgtacatgtatgtgttaaaagtaaattaaactctgactctgcctcatttttctcagataacaagcaaaataataggatgttctataaattgtgtagaatactattaatccatggtatttcacaggtatgaaaagaaatattgtaatggattttaagtctccagaagtagagctaattatagaaatgttaaatatgtataaataaattatcttgccccatgtggaaattatgttttctattttttataatatgaccacctagattaaggagaaattaaattaagctttattgatattgctagaaaatggaaaacagttaaatctgttctgaaatggttttaataaaagcaactctttaaaatgcaaaattatattattgattgatttaggatttacatttgtatgaagtgagttaggctgagttttgtaccttcagctagtagttttaaaacttgggagatactataaaatttaccatgaaagatgatggtttcaattttgtttttaaacctgataaaatgtgtctgaaaccaaaagaggatgacatgattatatttataagaataatttggaaaggtagataagatgtctttaaaaaaacatatttctttatcagtctaacttaagtataaatggtaattataattacttctcagatttgttttttaatgataaagagcttttcttatcactctaagtataataaagtacatattgcatgaatttggaataattctgcatacactgagtaacatcaataactattcattggaaatctgttgacagctttgtcattctttttttctaatctagtagctcgtaaatttatttgtataagattaattcagttttgcttaaaattcatcacacttggtgggcccagtgacactcacctataatcccagccaatcaggaaactgaggcaggaggatcactggaacccaagagtttgagtccagtgtgggcaacacagcaaaatccccatctcaaaataaaacaaaacaaaatttatcactttgcatatattaatagttttaattacgtcaataatatagctgagcacagtgtgtattttagcatgtacttctgtaagttttggatatcttataatctaatgtattcacacaggactatagttttaaggtaatggactttaaaatttatataagaatatatacctttgaaataaatttccttttttttttttaatagaagcaaggtcttgctctgccagccaggctgtagcacagtagcaccaccatagctcactgcagcctcaaactcctgtgcttgtgccaccatgcctggctaacttttaaatattttatagtgatggtatctctctctgttttccaggctggtcttgaaatcctggcctcaagcaatccccccttcctgggcctcccaaagtgctgggattacaggcatgacctaccacacctagccaaaaatttatctttaaaattttccagggaatgtaattgtgggcaaaataatctttacattttctatttgtttatatggaatattgtcttctgctttattttatcaaagaaaccctaatatcttaatgtatatatttgggaaatgttgtcttatttcttctagtacttagttctgacatgatatctacatagccttgctaaaaatgtagttgtccttgggctgcctaatagctgtatatatttaagtatttaaatgaataacttaaggcaattcttaagcgttgaattgatttcttattagtgagatttatgttatgattacacagattgtttagaatcatatcaagaacttaaatagaactggacaacagttctggacagaatacgaacttctattggcattgacaactgaatatttcagcattgcaaacaaattatgagaagggagtaaaaatacttccaataagtaacaaagttcctcatgatgatacaggagtttacttttttaaccctattttacctgtttattataatagataaaatatgaaaattttagaatattttatatagtgtgagatattcttattacataaaggaagaacttataagaagtatataagaatttcttaggcaaaaactcaataccaaagattctcccaacttccagttgataattaccaaaattattggggttttttgtttgtttattttttgtttttttgtttttttgttttttttttttttgagacagggtcttgttctgtcgcccaggctggagtgtagtggcgcaatctcagctcactgcagcctccatctcccaggttcaagcaattcttttgcctcccagtattacaagtccaagtgcttcagcctcccaggattacaggcatgtgccagtttgtatttttagtggagatggggtttcaccatgttggccaggctggtcttcaactcctggcctcaggtgatctgcctgcctcggcctcccaaagtgctgggattatagccatgagccaccgggcccgaccaaaattcttaagttttcatggtgttttagtcacctcaggctgctataacaaattgactgggtggtttaaaaaagagaaatttatttttcacggttctgggaggcttgtgccagcattgtgggattctggtgaaagcactcttcctagtttgcagatggctgtcttttcgttgtgtcttcacgtggcagaaatcagagaaagggaaagcaaggtctttcttgccccttctaataggagcagtaatcccatcatgagggctccacccttatgacctaattacctcccaaagggctcatctccagatactgtcatattggggatttatggtatcaccaggaatttttgagggacacaaatgttcagcatatgtgtccgggcacggacacgtacaaatttaggccaggcgtggtggctcaggcctgtaatcccagcactttgagaggccgaggcgggcggatcatgaagtcaagagatcaagaccatcctagccaacatggtaaaccccgtctctacttaaaaacaaaaaaaaaaaaaatcaaaaattagctgggcctggcggcatgcacctgtagtcccagctactcaggaggctgaggcaggagaattgcttgaacccgggtggcagaagttggcagtgagccgagatcgcgccattgcactccagtctggcaagtgagcaagactccatctcaaaaacaaaaaaaacaaaaaaaacccataatttattgtacttcaggttttaggcatgctataaatctgggtttatatatatggcagttaaggaaaaatgcttagcaaaagacactttgcccataagattgaagagtaaacattttcaaacttaaaaatgtcaccgtattctcttattcctaagataaaagtaagattttctgaatgttaaaattattatttttaagtcaaaaatatggtatttacttttgtttacttttaaatttggtttctgagtattctctctgaaataaaattatagtacaaataaagcctgtcttctttagtagtgtattgtcaacttctacccaacagggtctatgaatcaagtactaccaggctgacgctccgtgagggccaatttactattcttgcctatcatattgctgcagtctcactcaaaataaaagtcgtggtaactgaaaaattacactagaaccttcaaaagggacacatcttgttgcttgaacagcaaatgaaaatgcatgtattaataaaagattattttagagctccatttgtacttaaggacagtaagctactgtatttttagacaaatgtagggcacattgtgaaaacacagagttactgtccaataagttttttagcatatttccttatgctataatagagacagcactgaattgcatagattctaatttcatcttgactcttagccctctgtgaaatctggggcaagtattttcatttcttcaggcttcagttttctcactcatgtagagagcaaaccagatgatcttcaagtctcctcactcataaaacaattaaaatcatcataatgttaacatttaagtagcatttaatgtaaacatttaacatttaaaatccaaagcatatgagctagatcataatttgtaacatagaaaagtgaatacttaatgctttttatccaaaaatgatattattattgaattatattattatttgaacaatctatttaattcctaacattagtcattggcaatttcttgaaaaagtgtctagtaaccttttcctctgtttttctttcaccgttgaatagttttcaggtgtatttctagactgtgatgtttgtgactgtatgttagtaatttcggtatccatcaaccagaaatagtaattcattctcctcagaagtgtgtattgccttagattaaataagtaacctgttagcaaaaaaagttaaaggatatttttattcattattttggttcattttataatacacagtgtatgatcaaattaagtgatgatttttaactaaaacttcttagacaagttttctgggaaaaaatgatcttacaacaggcagcaacttagagtattataaattaagatacaaagaagaggataaaaaaggaaaaaaaattaggagtatcacattattccctatcaagacatagccaattaatttcattgtctttggggtgagagcattgcttataggaatttttctaaaagatccagttctttccctctagtcaccaatcctgaaagaaataaacatggggattagctaactactctctcaccttggcagtattttacaagaaagtgagctaattaacctccttctttctttccttccttcttcccacaccatctcttctctttccttctttctctctcttttttttctctaaccatttttctagctgctacacataggcaattatggtacttcgtggtgcgatactgaaatacatgaaaactagttgttgccttaagaaggtcaaggctagtggaggacatggacatttaaataattataatacagttataatcactgctattataaagatatattcaattgttgaatattccaaagtgatatatattaaataactactaattccatattttcattgagtaaggaagtgcaaataaataggaaagaatctggggagataccacttaaaccatggtggaacagaggatttttaaatacattaaggcagaagttctgagacatgaatttacatccctaattctgccatatcctagcatgtggtatatcatctcagaccgttacctttttcttaatggtaatattttgtcatgatcagactgttactattaatctaaatattaattttaatttggtttcagtaaggttccagactaaagcaaaagcaagaaagggataagaaaggaaaaaatacaagactattacaaagtatgtgtaaataggttttggtatttgattgagttacttcactcatttatttaataaatatcttttgagtgccaggccctattcttgaggcttttaataaaataatggctgagcgaggtggctctagcctgtaatcccagcactttgggaggccgagatgggaggatcacttgaggtcaggagtttgagaccagcctgaccaacatggtgaaacctcgtctctactaaaaatacaaaaattagccaggcgtggtgacacacgcctgtaatcccagcacttgggagactgaggcaggagaatcacttgaatccggaaggcggaggttgcagtgagcatagatcacgccattgcactccagcctgggcaacaagagtgagactccatctcaaaaaataaataaaaataaaataatataatagaataaagtaatgaactaacacacaaaatccctgtcatcatggagtttatattctgatggggggactgaaaaagaagtgcaaaatattgggtataagatgataatagtagagaagggtgacagtgtgtgtcagtcagaggagatggaagcattgcctcacttcccagaaaggagaatgtggatttaaatcccagaagtaagtggagattttttttttgtatgtggagatttaagagttctgagctttgtgggtgattgaaattaacagggataaaggggatatataatgagatttgcactggtaatctgaaggctgatattagatgtgaagctgtaagtgctagggttagggtaggagttcgtttttacctggagcatgcagagttctagggcttagttccctcaaacatatagggctggaggggtgatcttatacaaagcagttcaaattcaggcttccctcttgacctgaacataggaagcaaagggaaagaaagaaatagcaatgacatcagtgctcctattttgggtaactatgactattgaaaaaaagtttgggatgtcaatagggttaggagttttgagtggatgaagagtaaaagattttagaaattttgaattttcatgtaaggcctgaaattggcctgaagctaattggagaatggatctgcatatttctatttagattcatacttaatctggtgaaaggaaatgagaacaatctatgttattactgaaataggtattaacttcatgtttaacttcagcttttaaaataatggtaattttaaaagacattaattattccaccttcagattattttaaactattaactcttcaaatgtttacattttctattacactatgtactttctgaatagagtacttgacagtcaacaagttatctttcttctcagaatcccaagaaatatgattctaaagaaagttttattgtattgctgaataaagaatgtatgatttaccaaatgatgctatattttaatatcttagttttcaatgtgctgaagtcattgcattgttgccgtgttatttttatataatataatttccaaaaaatgctgaatacattagactgaagtcaaatgacatttttagacaaagaaaaatttgcatttgaaaatggaagtgtggagatttttgccattttaagggagatatttaattattgtttataaaatatggtataatgctaactttcactcagtatgtgtatatttttattttatttaatgtatatgtagaggaaatgatcttacgatatttaaacaactctaaaaagcatttctaattattataggaaataattctgaaaagtctggtacacagaaaaatcatctatatcttttattatgtagaatgcactagttcattctacataggcaggagtttcctccattaaaaaaattaaaacctttaagtatgaaattttacagtagttgtaagaatcaatgagtatgacaggtattatttacactaaatttttgattatgtgcatcattggggacaggaggctaatacaacagtagactttttttagaaatagcatttgatatgcaaagtagatttttctgttatttcttaaatatgttccatgtagtaataggacatggccaaatgtaaaacattggtagattacaaaaaaaaaaaatacaaatagtgattaactagtatttttaaaccaatttaaacatataggcccgataatgctttaaattattttcaaagctcaaaatgcaaatgggcaaatgtttaaaatgcactataatataaaattacttcaaatcttgtaggaaaataggagaatagtaaagtcagaaagttaataagatgcagaataaagttaaatcagctaatttccaaataaaatttctatacaccaacacatgaaaaaattctaaagtggattttcttatactgtctgccatgtgcaataaagcaaagctcaataaaataaagtatgcctatatgtggaatcaacaacaaaagtggacctgtgcaattacaccaactgctatactgaaaataacatcttggtattttttaatttaaaagcagccagtgcaaaattttttttaatttaaagatatgcaatcatgtctatatatgagagaaaaacaaaactttttttcttaaatacttcttaagtgtatggtaatcagaatgacacaaagaagccaatatggttctagatatactaagaactaactgaaaataatgcagaacatatttaaccaaaaaggaaaatgtgaatagctggggctggagaaatccagtattatctattatctgctttctgcttgccagtggacttagaaatataaccataaaaatcttttctaagcacaggaaaagcaaaactaacaaagtgagattaaaaatatatcacttggttagatggtgagttagtgagttcattttgcctcttctcactcaatgtcactttttgttagcctctaccagggttctcaaatggtttttgtcacttgcaatagaatcgccagagaaatctcaaaataaaatatctgcccctcatgccaaaagtatcttattagaattcctgaggctaagaccacagactgtattcttgaaaagctcttcaagtggttgtggtgaatactaaaatttgagaactatttttctaattaatttagaaattgtatacttcatatgctcttccaattggaccatataattcaagggcaaaatttagtgcttggctttttgcccagatgccttggagaatgtccagctttatggaattttcaccaaaagctttgccaaaagagaagcagacctgtccaacctgcagtaaaaggagctgaagaccaatgatgacaatcagcattctgtgatttgtcagtttgccctatagagaacaaagagcactttgatttaatggtcatgtctatagatattttatcattaaatatgaaaaacaagaagacaaagcagaaaaaaatagatcaaatcttagtgagtggggagtagctgcagcaggaggcagtggaggtggtaagcagcagactaccacccagaaaagagaatcagcggtagaggaaagactaaaatccaaacagtatatagaattgtgttgtgctgcccgtggtaaaggactatgtctgcatacatataaatctggatgtctagaccatgttctctctcagttattgtagctgaatagaaagtaagtgtctgtatgttctggtcaagttaaaagtctaaacacttttaaatgacaattgactgagcgatatgtattttaagaaagcttcacttcaagagagacagcacaaatgctagggccatgttgcttttgttgaaaccctgattccaacatcctcctcaagttttatgatttctcagttttctcttctttaatctggataatcatagtacttatatcagattctttatgaggtttaaattagtgcatgtacctacttagaataatgcctagtacataatagatggttattgtcatcattgttactattcaaactaagagacaaaattaaagagcttgagtaaagtgttagtaaatcataaagctttaaaaggatgctgtggcactatgaataacatctctattactacaggagatatcttaaatgatcctagagaataatttttttaaaattgatatgttaatgatgaccaacttataccatgatattgaatcagtaaatcaggtgtctccagtttgaaaacaaataagaattgactacctgttcttaaatgtatggtattcttggtgacaaaaaattataattctaaaacctttcaaaaggtcacacatatttaactactcaaaaactgcaagctaaatctaatttttatatttgcggggaaagttttcagagccccaaaatagttgatgaataaatgaatagctgttgattcctgaaggtctcttccaattttatgagaagtgaagttgtaataagaggcttatctttgctggccgcctttgtgtttacaaagtttctcctcctcagaagcaaagtttagtgttggctgacttaggtttcttgtgattgaggctagaaggtggactagatcagtgattccccaatctttttagcaccagggaccagtttcatggaagaaaccggttttatgtcttactgtggttgagaaaaagcaagtctaattttatttacttaatgaaaattaataaaagtttggaagctgagagactattgtcaaaatgcaaaataaaaggttggccaatcaaaaaacaagcaaacatgtataaatggaaaaatagtttttttactgggttctcttaccttttttgcaactgtagtgaaacaattttcaaactcacttggggatatcaaaacttttccatggctagataataaatagtgccagctaaatcaagtgataggtacaatctgattttaaatatgacctatggggtaataaaatgcattggggttttgctggtggggcctaagtcctccaatatagtacagtactcaagcaaatggtctctagaaccaggttaaattggctttacattagaaccacacattggcttgtgaccttcccaaatattcagtttcttcaacagcaaaataggaacaattacctaacttaaagaacgttagaaatgtggaatgagatttttaaaatatgtgagtgcttgtaacacaatgcctaccatagggtaagctttcaatacatgttaggcaaagttagaagctgttgtttttatgtagtggaatcaacatactttgaatgaaactgaaaagtagcacattgatggcattagtaaaaattattttttaaaaaggcaagaaataaatttttataaagctgctttggtcttttatttccttagtacttttcaagatagaaaaaatccctgcaaatacacttgcctcaagagctaagggattagagaggaatggcaagttttcaagctagttttcatcagtgctaccctaaggctagtgcccattcagctcaaagttctaaattatctgaaactcagaataataaataatatttataattattatccttttagcaagaaagagttaaattatttcagtggtttttgtaaaatgcaggaaaataaataataccctgcttttacattttagttaagtattaactctctagaatattcacttttttcaggttaactttttccataagtatgcctgcttttggctattctaaaataaaataccctaaattatcttattctaaaagaaaacgttggccacttacagctgtacttgttttaatttaagttataattacatcagaagtgacctaaggattcacaaaaaaggataaaacttgaagcaaaaccattgattcagcaaacatctcttgagtcttacccatctaggctcaattccaatcaatgttcggcccagagctggttcctagtaagagttcactatattggaagagtgaatgaataggcaaatcaatgaatgaatagcatgtgttgtatatagcattgtgttaagagtgcagactctggaaccagacagttgggtttgaatcctggctctcccacttactgtcttgtgttaacatgtaaccttggatgagttacttagcctcactgtgcccacttttctcatttatgtaattatgatgataataatacttcctcattggattgtttgaggattaagttaaaactagcaaagcacttacaacaataccacatagtaaacagtgataaatggttgcaaaaaaaaacaataaaaaagaaatagaaatataacttttgccctcaaagacaaaacttatacgtgaaatgccagtacttacaaaatcatgtactactaatttaacattactgggaataaataccagcttggtaactcatgttgccacctgatactgactctgcccaaaagcagcatctcatttcccaaatgcaggtcacaggggatttgcatctagtccagagtaacactcaagaattgcttcatcagagtatatcttaactcatgtagcctaaggttctataaacaacataaatttttatcatattaaatgacattaagtcactcaactgaaacaggtgaaacagggagtttcttctgaggcaatttgaaatgatagctaattaattgtacctagggagatcaccaaatctgctaattttagaagtgggaatgatctggcactaaatttaaattcttcccagtcactatctgatccacagggtcatacagccaacatgggcaagaatgagtatgtccagttttgggatggtggggtatttataaattcttctgtgctgattagttggatatttgatcaaacaattgccaaaggcctttacaagagtaatacattttaaataaataatgagttttactttctaaactttaaggaattaagatacataaaaataatctatctcagccagtcccagtggttcacgcctgtaatcccagcactttgggaggccgaggtgggtggatcacctgaggtcaggagtttgagaccagcctgaccaacatggagaaacacccatctctactaaaaatacaaaattagctgggcgtagtggcacatgcctgtaaccccagctactagggaggctgaggcaggagaatcgcttgaacctgggaggcggaggttgcggtgagccaagatcgcgccattgtactccagcctgggcaacaagagcgaaactccatcacaaaaaaataaaaaataaaaaatctatctcttacgtaacaaaataaatagtaatatttgtttaactcccagctgtgccccatttcattaaatttttgttttcttcagtatgctagactgaatttaaattaaaaaatagttacacctgttttaaatagagtggctaaatatattttacatttgcaggaggaaaaaaatatatttgttgtttatagaatcttgggctcagtgggctaaggtgtgacctaatttgcaatttctgaatgttattctagactagatgtaaaaataatttcttccttcaattatgccttacatcttgactttaaaagtggctgaagaataaagtggtacattttgactaaattgtttatatgaagggaaaaaagtgagacttaagattttatggccaggcacaatggcttatgcctgtaatcccagcattttgagagtgtgaggcaggatagatcccttgagcccaggagttccagaccagcctgggcaacatagcgagaccttgtctctattaaaaaaaaaaaaagtagccacgtgtggcagtgcaatcctgtaggtctagctacatagaggctgaggcagaaggatcacttgagcaaaggagtttgaggttacaatcagccctagtaatacaactacactccggcctgggaacgagcaagaccctgtctcaaagaaataaataagattttataacaaatcaataaaaacatttcttgacatcccactgtaggcgttaattgtctgcacattgttgagagtataatctaaacataacctgtggttcctggaagatggaaggattagcttaagtggaagaaggaggaagctgtgccagatagggcgatgcattctgtattatcatagaagcaaaaatgggttcatcatcagacaacagcttggcctacaaagaactgaggactgttgtgaaacatacagatgggcagatatttgtggatttcttcatttcttactggaaattctttattatttgatgtctttaccattcacttagcacttgccatgttttaccttgggattgttttgtctttatgcttcatctagcaatctaggttataagtgactttggaacaaatgttgtgtcttgtatttctttttaattagcatagcattgactccagtgccttatacatagtagatgtacagataatatgtgttaattggttgacatctatatatttctaaaacatttattaggaaggtttactttatcatcagcaaatatttattgaatacctaaatgatttacaaacatttctaaatgcagcttgaatattagtatttaactatccttacgttactaggagttttcattcaaatagtaaatttattgaattaatttattcaataaattctttctttagagttattaagtgccacgtatcaggtagtaggctgctgaggtaacatagacaaaatatccaaatgccatgagggcaaacaattgcaatagaagaatttccataatggatatatagtaagatcctgagaaaacactgtaattgatatccaaaaattcattatgtcagatgcaatgtggaaatactaggttcatgtaatgatctgggtgaacctgtacaccgagcagtcctgctgcataaccgctgcccagattccagctacaatttgacgccacctggtggcagttttctactctagtaaaaatacccaaaatgaaaatgattctgaatcctgtagctgactgaaacttttagcatagtggcagaagtccaggtacctctttcttggtttcccaagcctatggaagaggattgggggacctactttccatctccctgtttctcaaaatgggcttgggagccttgccatcctcaccacatccccctcttcagagatgagaattttaacccaccaatttgccaacaggtgcttaggcggaagataagagcaaattggcaaaagtgttatctaatttcacattactgaggaaaatgttatttcaaagtttttctgtatatacagttggcataaaagaaagcacatcaaagttatcccagctagagggtggagattaggtaagacttcacagaggaactcttattcaagcagagacttagtaaaccaagtggccatgtgcaagaacggtatttatgaaagagaaaaaagcagatgtcaaggcacataaaactgaaattaggcaggtatttcagtaactacatatagtgatgtatttctagagcatttagtttaagagggaaaagagaaggaggtgaagtcaatgttacgcataggtcagagcattactcattttgtaggccatgcaacggagcttctattttattctatagatgaaggagtcattaaagaaattctctcaataattttacctataaaatattactataaacatatctttctcatccgtaaaatagacatcatagtataatagtgcctacttcacagagttgtgtaagttaaagagaaaatgtgtgaagtattttgcatagagtccagcatagattattatgtaagtggtagctattagcgttgttattaatattactataaataatgattggagtgggcaaggctagaggcagagataggaaactaaaccaacctaaacttgctgattggttggatagagagagtaaggataagagaacacatatcttaaatttcttggattctgatctgggcagttagatggataatgttgtccctcaggtagtctgaggagaaaatatatatgaatgcatgcatgtgttaattaatacattatttaaaataaatatgttatatttgatgatacatagacaacctggaataatcaactaataatcacttcatccattcacatgatatatgaaaatgaaattgagttggatttctttacccttagaaaagatggtaagtggttggaagcaatcatgcagttattgctctaggaggtgagtaatacattaagctaaaaacaatattttaaatttgtggaggagagaaaattgaatctttcaaaaaaggaaaataatggtgaataaagggaaaggcaagagagaaaaacatatgcacagtggatggcaactaaatctgaccaaggcaggaactgaggattggggtttattggggaatatttctggcaaatacctttatgtaaactggattgatttaaaaccaaagagtgatttacatttaataatacaagcactatagaattttgaaaagaagtaaataatgggaactaattgccattttatgttattattgtgattatgaaagaatgtgtgaaagatgagaggataaaagtaaagattctaattcttaattgcatctgtaatcttctaaattcataaaatacatattttctgtttctgttacaatcaaatgcatatgcacattcaaataatttagaaagttattcattttccttttcttattttgtatgttaacataattagaactaagataaatgcattttagagtatttgttattttcgtggatggaatattcatgttctttattactctaagcttattaatcattattttaaaattctactttgcagactttctttttgggtcatttcagaatttgtcttctgtaacagaattagattatattccataatatctatttcattaagtttacagttgaagaactgaggtcagaaaaatcaatatcatatgtctcagggtatatgctgtatatgctatctagagctaatgttggaactccagtctcatgagcctaggtacttattacctaaatttgctaatatttaaaagcatggaactaccttttaataggccaaatacttgaatttccaaccttttttctgacctgctatattataggagggaatgaaagcaaaaatgttgaccgggtatacagagataaaataaacctctgatggtaggtgttataaaattcctgactaagggatataggaggacagataagcacaattaccacagcgtatcatacctgtacggtaaggcagagtaacagctacatgcagacagtttttacaggtctgaaagaattgagcaaaacaaaaggagtgacctgtatgttgtttactaaacatcaaatgaagacttagtattttttcacgtggcatgtagtttgtattatgtaagtctctgccagcagttctcaaaatgtgcttgctggatctgcaccatctgcatcacctgggaatttgttagaaatgctgttttcaggtatcaccccagacctaatgaaccaaaaactttgtgttttaacaagccctccaggtaattctgatgcaggttaaagtgtggcaacccctgctctaagctaaggggaattcgtattcatcttatactactggtaaagttggtaactaaaaacttaagttctagtgtcagactgctgggttcaaatactagcaatgaaaccttcagcaaacttcataacctttctgcccttcatgttccacatctgtatttgtaccattttaagtggggtacgtaacatgtgaagctgagttggagaagagcttgacatttttgagaaatttagaaaaggccactgtggctaaagagttgtttacaaagacaaatggcttgacatttaggtgaaagagaaaggcagagaccagatctccaaaatcttgtaggactctattagagaagagagtgggatcctgaggtcctgtggaggaattgatttttccaaggagaagggacactttttgttataggcacaagaaagagaggatagggtgcagaacaattaggtttatagactggtatttggaagataagggaattccttctgatattttatattttatggattttggatttttcccaagtacaatgagaagacactgaagaattttagtagcagactgccataaaatgatttgtattttagaaaaatcaagtggcttctatgtggagaatgagttgcagttgaaacataagcatgtaggatgctgttgcagtagagagtggcatggatttgaatggtcaaaatctggatggggagaagtggaaggatatgtaatatattttagagatagaatctgtaagacttagtgatagattaggtatggggatgaaggaaagggagaaatcaagggtgcctctggatttttaccttcagcaactaggtaaatagttatactctttactgaaataaggaacactgaagaaggaatatgtttgagagaaaagattaaattcaatttggaacacatcaaatttgtgatattctgtgtaacatctgagtgcttgttacaactaggcaactgggtagatatgaagttcagaaagaagctcagcctactaacttaaatttggagattatatatatttacaaataatctttaatatatgatacatatgtatcatatgaggagacctcaaaaagtttgtgaaaaaatggaattaaaagataaaaattttaaaaagtaaatgttatttctcaacataagccgcagcaaattcaagatactttggggccaggcacagtggctcacgcctgtaattccagcactttgagaggccaaggcaggtggatcatttgaggtcaggagttcaagaccagcttgaccagcatggtgagatctcatctctactaaaaatacaaaaattagccgagcatggtgttgagcgcctacaatcccagctactctggaggctgaggtaggagaattgcttgaacccgggaggcggagcttgcagtgagccaagatcgtgccactgcactccagccagggtgacagagcgagacttcatctcaaaaacaaacaaacaaaatcgattgaaagctctgcttttgtctgcaggtaatctgaatccaacaggtttggcacccattgagtgcaaagtttactcaactttaattattcagtcagaattgtgtaagctgaaccaattgagatgtctatggtgttggctattgtttgtgctattaattgttgatcctctttgattaggcacaaataagattaattttttcctcacaaattgatgtggatggtctaccactgggggcttcatcttgaacatatcattttgtcccttcttaaaacaagttatccatttgtaaactgctgatttctttggggcattgtccccataaacttttcataaaatattagtgatttcaccattcttctacccaaacttcatcctaaatgtgttgttcttacttcaatttaagcagaatttatattgctctgacaggggatcttttcaaatggatgtcttattcttcttagtacctcaaaatagatcctgttcagacatgttacaacaagttagtatgagcttatttttggtgcaaaaaaaatttgaaattcatgaagtttttttcataatatgaattttccattaatttttgaaaacttcatgtatatggtataagggaatttcgtctgatagcatctattttctctatgaaatgtaaggagaagtctgcagagaggaaagcagaaggtgagagatttgaatagcatgaagaaggtaggtatgcactccttattgtatgagtggggagaacatatatgctgtaattttgaggccaatgatagtgaactatagtggagcaactgtgctctactgaatttttttcaagaatgctgatatgggccaggcatggtggttcatgcctgtaatcccagcactttgggaggccaaggcaggcagatggctcaagcccagaagtagttaagaccagcctggggaacttggccagacttgatctctacaaaaaggagaaatagaaaaaattagtcaggtgtggtggtgcatgtctgtagtcccaactacctgggaggctgaggtgggaggatcacttgagcccaagaggtcaaggttacaatgagttgtgatcacgccagtgcactccagcctgggtgccagagtgagaccttgtctcccaacctcaaaaaaaaaaaaaaaaaaaaaagaatgctgaaatgttgagatgtacacagagaagcagcatgtggtaggatttatcaaggagttcagccagttggatgtcttatgaggagggatactcaaaagtttaagatatttgcaaaagagtgtttgaaatgatgggctgtggaatctaagttggttaagtataaatgaagaggaaggggctgatacttggagaaaaagtggagggctcaaggttctcaaaatgttgaagaatagagataactaattaattgagctggaaggaaaggagacagaaagccttgtagcagccttgtggatactgttggggtaatcttctggataatgttatccccgttttatacaatatggaaactgaggcacaaagactactttgattattcagttacaacttgattagtgtagctatgtctcgaacgtgagttttctaattaaattcagttggcttaccagtagagaattactctgtctactcaatatacaaatcatccatgtactttgttcaacacttttgccgtaagtgtgttcaggttacagtggtgacttttttgatgacccatttattgtctatcttatgtctctactctcactgagcatttttatccaattttaattaacatttagctaaaagcaataatacagcacttaaattgtcatccttaacagacaaaaaggggtgtatgggaaagtctacattttggagttttggaatgttttctagggataatctaaggaataaagggaatttccaattttaagaattatttaccaacaaaaatgaagagtaaatttattcacgtggattgtgtatagcatttcatttatgccaaaagtgtataactttcaatttagtgccaaccataatatttgacattttgtagataataaatcagtctcttcatagaatcaacctaaatgcccatcagtgatagactgtataaagaaaatgtggtacatatacaccatggaatgctatgcagccataaaaatgaattcaatcatgtcctttgcagggacatggatagagctggaggccattatccttagcaaactaacacaggaacagaaatttaaataccacctgttctcacttataagtgggagttaaatgatgagaacacatggacacagagaggggaacaagacacactggagccttttggagggtggagggtgggaggagggagaaaaacaggaaaaataactaatgagtactaagcttaatacctgggtaatgagataatctgtgcaacaaacccctgtaacacaagtttacctatgtaacaacctgcacttgtaccccggatttaaaagttaaaaaaaattcaattgtactcatatattaacaataaataatctgaaaattaacaaattagtctatgaaattaaatttacttgtatatgcattattatcagtcatctacatgccaggattattttatgaatggtttttattgaattacatacttttcaaatttgaaattaccaaaggtatggggattatttggctgtaggaaatctgagggactgtttcttcaaggccacagaccatctctgtttatataaaatagctgcttcttcaaataaatctaataagtttgtttatatttttagtaaagccttagtgcctccatgtaattgtaaatatacataataattagagtcaacgtatcttaaccatattctagacattgtgctaattgctatatatatgttacttcattgaggttgcttcgttaattcatgaggattacctcatcacaacgttgagagagttacatttgttttaaagattaactcatttattcaacatatatttgctgaaaacttaccatgtggcaaacattattttaaaacctacaatttaccaatgaacaaaagaagaaaagtctttgtcccatttatacattcattatatattacaatcatgtatataataaatagatggcatatgataaatagcagaaaggtatataatcaatagaagatacttagaagagaagcatagctttattcttgacatcctcactgaatagattgccttgtttatttgttcatttgtaggtttgtttaatgagatcacagatgtaactgcttcacatatatgttagaaattctacgttagaaaaaaatgattcaccatttcttacaaacaatccagttatactcttttagttatttttaaatgtataataagttgttaactacagtcaccctgttgtgctttcaaatactagatattgttcattctatctaatcatatttttgtgcccattaatcatccctattctccccacctgccaccgccactacccttctcagcctctgataaccatcgttctgtaatctaggtccatgcgtgtagttgttttaatttttagctcctgcaaataagtgaaaacatgcaaagtttgtctttctgtggctggcctatttcacttaacataacgtcctccagttccatccatgttgttgtaaatgataggatttcattcttttatatggctgaatagtactccattgtatgtatgtaccacattttctttatccattcatctgttgatgaatacttaggttgcttccaaatcttggctgtcatgaatagtgctgcaataaccatgagaatgcagatatctcttcaatttgggtgtatatctcacagtgggatttctggataatatggtagttctgtttttagtttcttgaggaacctccaaacttgtcttcatagtagttgtactaatttacattcccaccaacggtgtaagagggttcccttttttgcacattctcgccagcattcatcacctcttttttcgataaaatccattttaaccagggtgaaatgatatttcattgtagttttgatttgcatttctctaatgattagtgatgttgaatgccttctcatgtacctgtttgccatttgtatgtcttcttttgataaatttctatttagatctttcgcccatttaaaaattggattattacattttttcctgttgactgaactccttgtatattctggttattaatcccttgtcagacgggtagtttgcaaatattttctcctattctgtggattgtctcttcactttgttgtttcctttgctgtggcggaagccttttaacctgatgtgatcccatttgtccatttttgctttggttgcctgagcttgtgaggtattactcgagaaatctttgcccagaccagtgtcctggagagtttccccaatgttttcttttagtagtttcataatttgaggtcttaaatttaaatatttaatcaattttgatttgatttttgtatatggcaagagatagggatctagttttatttttctgcatatggatgtcttgttttccagcaccatttattgaagagactgttctaacctcaatgtatgttcttaacacctttgtcaaaaatgacttcagtggaggtgtctgaatttgtttctgggatctcttttgtgttccattggtctatatgtctgtttttattccaggatcatgctgttttggttaatatagctctgtagtataatttgaagtcagataatgtgattcctccagttttgttctttttgtttaggatagctttagctattctgagtcttttgtgtctccatataaattttagggttattgtttctatttctgtgaagaatatttgtattgtgatacagattacattgaatctgtagattgctttgggtagtatggacattttaacaatattgattcttccagtccatgaacatggaatatctttccattttttgtgtcctcttcaatttctcctgtcagtgttttgtagttttattatagagatatttcacttctttggttaagtttatcctaggcattttatgtcatttgtagctattatatgtgagattactttcttgatttctttttcagattgtttactgttgccatatagaaatgctactgatttttgtatgtcaattttatgtcctgcaactttcctgaatttgtttatcaattctaatagtttttttggtgtagtctttaggtttttccaaatataaaatcctatcatctgcaaacaaagataatttgacttctttctttccaatttggatgccctttgtttatttctcttgtctgattgatctagctaggacttccagtatgatgttgaataatagtggtgaaaatggccatctttgccatgtttcagatcttgcaggaaaggctttcagcttttccccattcagtatgatactagctgtgggtctattgtgtatggcttttactgagtttaggtatgttccttctatacccagttttttgaaggttttcatcctgaagggatatttaattttatcaaatgctttttcagcatcagttgaaattatcatatggtttttgtccttcattctgttgatacaatgtatcacattgattgatttacatatgttgaaccatcttcgcatcgctaggatcaatcccacttggtcatgatgaaagttctttttaatgtattgttgaattcagtttgctatttttgaagatttttgcatcttaaaaccatgatatgtgcattctaaccactgtattatttataatattctcttgaatatttttctctctctacatgtcataatttttacccaccattcaagacccaagtttataaagcttttctcatctctgattctcaatattatccttccctccagtgaaatttcataacactgggtttattcccttttctctgtacttataacttttgctaatttgtataagcattttcactcatatttgtacccctaaagcacgtgtcccttagataataactatgtctcatgtcttatttattgttcttattgaccacagggccaaagctaccatttgcctaaatggaggctttgcacaaattagaaaaagtggtacctctaggtagataattagaaatggatacttgctttgaacagaacaattagagaaaattccttctttatgtgaagaaaaaaatgtattcttcctttttgtcaatttcagtccccgtatgccagagcatggagggcaggtaccatttcagcccccacttgctgccttgggacctaacaccaagtagatgcaaggtagatgtttgctaaaggaatcaatcaatttgtggcaagatgtttactatggtttaaattagctgagtacagaaatgtttgaactaaaaattcaaggggaaaaagaaacaaaatggaaaccaggtcatctctctgaggatgattaaaaataaagtagctgaaatcatcagagaagagatacagtttttgtaagatacatgttataatgaagacattttaaaaatcataatttttgggtacatttttatcttgacagaggaagcaagtgacacctatttttgaaacatgaacattttaaatgtagtttttgtgcttaattgtttttaaagaagacaaaacatagctagagagagtgcagggacatataactagcataaaaaaaagatactgaaaaattatcatttgatgatagacaaatgattaggtaccatgagcatggtgtgataaacagagaaacatatgatctataaagtaatacgtttaaaatttttctttaaagtaacttccttcaaactcatggtggagggagaggtctattattcaataatttggtagagaatttataaattcaagagatagtaaaggttcaatatatagacagactaaagagtttaaataaactttttgtgttcagttaataaaggaatattcctagtttccttaaagatttagccttcataaatttatcacttttaaggaagatagccatgatctctccaaaatgccctttgatgttgtatttggagacataatactgagctgaatcccaagtctcctgatacaagaacctgtgcaatctatgttctcacagtcttaggacagctctgatgtaatatctgaataggcagttaaatacgagtaagtcgtgcaggccatgcatttgtccccacacatgtaggccttatcctgtctacaatgctcaccttcacttcattccatttatatttagttttgtaaatttcctctaacaagcattctcattcctgcctcaggatatttgcacttgctcctctctaagcttagaacatgcttctttcatctgactgggttcatcattcagggctcagctaaattgtctcctcttcagagaggccttccttgacaaccttatttaatgttgttgccaaacttttcagtcccttgttattttattccatcttattttcttcagatcacatatcactatctaaaattatcaattatttatatgtttactgtctttcactatgacagtatgaatgaaagctccatgaaacaggagcattctatacttgtctgtgctatacctcttaattttgagaataatgcctgctacatagcctactacttttaatttaatttatttttgtttatttcaaagtaaatatcttcctttttttttttttttttctttttgcgacagagtttcgctcttgttgcccaggctggagtacaatggcgtgatctcggctcaaccacaacctccgcctcccgggttcaagcgattctcctgcctcaacctcctgaatagctgggattacaggtgcccgccaccacacccagctaatttttgttagttttagtagagatggggttttgccatgttggccaggctggtttcaaacttctcaccccaggtggtccacccgcctcggcctcccaaagtgctgggattacagacgtgagccactgcacctggcccaaagtaaatatcttttaaataagaatgtccaaatcccgggaatgtgacatgttaaaagggagcaaactttaagaaacaaatcatgtttttaaaaaaagaaatctttaatatattggaatttttggcattaacaagctcttgggaaaggaattttggaaattacaggcctcctggatgctccttaagttatcccaagtaagcagtgacctaccttgtgaccactgaaatactgcttcctgccatgagacctaagacttaagaaccttaaacatagattaattactaatggctataatcaaggcagatgtttttgactaaatatactttgttaattagccaaatgtttctccctaactctggacattttgtggcatagacacacacacagacacacgcgtgcaccctctaatacatttagatactatactgatacattcaagcgtattaacataatgtgtttatatacagtacttgcaataatgttaaaaatactaaactttaaatttctgtcatctccagaagtcaaagaattagtatgaaaaactcagtttttacatactcttcaaagagaggttttcatttaacttaattagggtttcttgacattagagttgaccattggaatttcagttgtaaaccaaaaccaagttcttatgcagccttatttgcgttttatatgctgatatttgccagcaaattaatcagagactatgtcatatcatttttgtatccgcatatttgtcataataggtgttcagtaaatctttgttgaataaatgattactactttactagcctaaaatcatagatggtaatctgagtttaagtgaaataaagtttatttgtagtaaattaggataatagtaatttcagctaccacattttaggaaaggaatggtatttaatgtagagaagtttttacataaaaggagaactttagacagaagccagatttttttgttgctgttttttttcctgcaaagaacatgcaagaaacggcactttaaaacccagacatttatccaattactgccaactggtgtgatgaagtatgagttatagtagtaacaggtattcagttaatttgtggcacctggctcaggaagcacaacagtaggaagaaaaaggaagtaagcctttcaagataccatgtttaggagcttgaccagtcctactgggtttgtttctaatctaccaggaatgctattgtcttcaaactcttgaacagtacaagccttatcaccactttcttgccaaagatgttatgaatagtttcactcctggaactatccctgtctactttctatccttcaatgtattttctgtccctgtgccacagtcctaattctccattgtattagctgttaggcctccacagaatcaccccagtctttcattccttggtaaattatttccagactaccttctcagctctaatgtgatgaaatatttgttttggcatgactttacattcttaagactcagaatttgtctttgtctcatctttgctatttattatctttaagccaaaccacttacctctattcattcaaacctataaatgaaaactttggccctatagcatataaacttcatttgatttaatcacatcttccaataatccctatatgctatttatgtatttggggaatacttgtgtttcacttgctttgtagttacttgtttttctcctaatgattgacaatactagatttgcctttttctttaaccattcaggatacaacttttcaacaactataattttgccataaatcaatctctgtattggcagttttatatatttaacttcgataatactaaatatatacagtttttattgtttttctaaagccaaaaattagaaatatgcacaaaacaatatttagaaatgtaaaaacagtgtccttttctagaaccgaacaccctatatcaacactcaatctattgtgtagtaatctgttaggattagctagaaatccatactgtacctttaacccatgacaagaactaatgtgggttgagtaatttgatttacataaaagaagaagcgatgttggaccttgattgctcttttcgtttgtctgttttaattttttttagttaccgacactttttatgtttattctggaaaaaacaaaatagaaaaagataaactttttttaaaacatagctatcaaccagaaaaaattaaaatgacttttagcagactggtcacagtatatcctttcatatttttggctacatacatttatatttttcccctaaaaataaaatttttctgaacacataattttatttttcttcatatctcttcattcttcttttgtgcagatgactggcgcatcatctcatgaatctaggcttctcaaattacttagtttagcacaaaatattgcttcttttttttataaaactatttttggatttctgtgactggaaaaactctgggatttgaatttacctgtgtcccctagtagtagggtaattccatatttgatacatatgtcgtccaaagctaagttacagatatctgcttctccctccccatcccccaccatcaagaatatctttttatgtccataaacatttatgtataacagcattttcaacagtacattgtcttttattgatgaacataatttatttaaacatccactgttgttggacatttgtgggtttttccccttgtcttattttgttttgtttttgctattataatcaattgtgcaataaatatcattatagctaaatctgtacacattgctaagttttcctttatgataaattgtaaagttgaaatgctaggttaaagggtaggcttgtttttttttaaagcttttgacatatattgccaagttgctctttagaaatctatcactgagatcccactagaagtgttgaaatatactgtatttccaaacccttataaaatttctcttttaaaaaaattactaatgtaatacgtcttttcctagccacattgagcattttaaaatattgcccataattacaaattctttactccaaagtatttcataaatcaagactcccaaaactttaaacactttttcaaaaatcaagagtcccaaaactttaaaaattttggtagcttgtggctgagcgtggtggctcacacctgtaatcccagctctttgggagaccaaggcgggagcatcacctgaggtcaggagttcaagaccagcctgaccaacatggagaaaccccgtctctactaaaaatacaataaataaataaataaataaataaataaataaataaataaattcgccggacatggtggtgcatgcctgcaatcccagctacttgtgaggctgcgacaggagaatcacttgaacccgggaggagagattgcggtgagctagatcgcgccattgcactccagcctgggcaacaagagcgaaactccatctcaaaaaaaaagaaaaatggtagcttatttgcttacaacattttttgcttatcgttttagatgatatccagtgaagaaagaaaaggaaccctcgctgcaatctttctctcatcaaaacacaccactctagtgctactattcataaactcatccctggtgatctctaagtttcaaggaaataaaaagagcatccatcttataaaacttttaataaccccttttgggccaggctcggtggctcaagcctgtaatcccaggactttgagaggatcaggagagaggatcacttgcgtccaggagttgagaccagcccgggcaacacagtgagaacctgtctcctctcccaaaaaaaaaaaaaaaaaaaaaaaagccaggtgtgctggcatgcactgtagtcctagcacttaggaagctaaagcaggaaaatcaaaatcacttgagcccaggggttcgaggttacgatgagctatgattgcaccactgcaccctagcctgggtgacagagcaaaacaccatctctaaaaaacaaatgaataaaaagaaataactccttttgtaaataatgctttattaaagttgttaggttgaagagaagtgcacttgtttcaaacaaagttctcattaaaatattgtttatctgcaaaatgatgtatcagttccagttagtattttattgtagtgtcttatttgattttggtcaagttctttatggccttgatattcaaacataaaaattcaaatgcaaaaatcacaagatacaattttgtgagtgtatctttgacatccttggtaattagtagattaggtggttctttagaagagtatatgttttgaataaaaatttctttttcttttttctgagacgggatctaactctgtcatcaaagctggagtgcagtggcaccatctcggctcactgcaatctcaacatctcgggctcaggtgatcctcctgtgcctccgaagtagctgggactacaggcatgtgccaccatgcctggctaattttttacttttttgtaaagatggggtctcacatgttgccaggctggtatcaaactcctgggcttaagcagtcgtcatgcctcagcctccctaagtgctagtattacagacgtgagccactgtgcacacccaaaaattgctatataacagaaacactaggttattctgagtatggaacataggttatataaaaagccttagtttctgttaaactttggctcttttaaacgataacaagccttttctttttactttctatcaaaataaaacaaacttgaaaattatcatttcaggatattgcagaaacatattctcatctcttttctcttctcttctcttcttttctcttctctccccacccacctgcgccttctctctctctccctcgcacacacacacactaactctctttgtcctgtttctgactatgtatgccacatttttttcttaaaacaaatgtgagggatataatagtatacttcactatatattttttaaatttcacactgggtcttttaccgcctaaatacttggagaagatattacataggttaataaaagtaatatgtggttctagcctttaaccagattttactctaggatagaaaacacttttttttttctggaagacaaagatattgaattagacataagagttcacctcaataagttagttttctaattctcatcctttaaataatgtttaaagatatttctgtttcttgatttttattcttttttattactttatgtattaaacattcattatcagaaccaaagtaaaactttctaatactgagtcaaaaattgatgtgtaaataagtattttcattcctgcaaaacagactgcttccctcatagtcctcctaggtttatgggggctagctggatagcctgcttccagattcttcgctttctaatctacctctaccataccccagaaatcgtggaaaaatccaaagtcatttctttaattactcccagttgcagtattagtcttgcagtagattatcaatcagctcacatgcctcagtgattcatcgattgctttctggcacactgtctggaaaactgataatgatttttctttctttcaaaagagtgcaagaagaaaatctttcttttctttatttttgtaatatagatttatatcagtaatgattaagtaaagtgaaataaagttattttttaattcaaagctaatgaaaatagcaagcctttttagaaaatttaaccattattagataaaccttattataagaaaacttacagggccactcttgaaatggatattatattatcagcctttttttttttttttttttggtaaaattttcccacttgtctaattaccttttgaaggcaacagtaaaatagagaagaatgtttttgtaagcttctcccttatgtcgtatggctacctttaggtgctgcaggacagcatagtgtcttaaatgaacccactgatttttcatgaatttttttcctgtgatcatgcaaatttgcaccttgtctttgacagcagaaataaaatcataaatctgattttgcatatttgctctaaggttggcccagagtaacaaagcacaatcaagaccatggtatttgaaattttttaactcctaaaaatatattccatagatgatataatttaattatactccaaatgttttatctaaaatgcattttctgtcttttcctttttactcttgtcctcacttttaatgatccatcggctgacagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgg

SEQ ID NO: 22 - DNA, 76778 bp, Homo sapiens
agatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtggtgcgcccagggctggggtcagggtgggcagggagggggccggtggcaatgctcacttatccctcggctcaccagggacggggtgtctgtgtgtttgcagctgtactccgtgcacctggacgggttcctcttctgcagggtgcgctacagccagctgcacggttggaacgaacaggtgagcagattggaggcgggtacgagcccatccactgagacaggtggagaaagctgtccccaaagcgctctgttcctctgactctggcaagacactgggcctttcacggcctcgggcttcctattgtgaaacagggtcctggtaaggatgaactgaattgcttggcatacagttggatgaatgcatgctgcggctcctggtcgcctacagctgtgagatgagggaaccgggcgcaggtgattcttccaagcccctcgcagttgcagccgggtgatccccgctagcgccgcctggcagggcgctggggctatgctgggccccatttcagtgcccgctgttccccaggacaatgcttccctccaaaatttggaaactgggtctagatcaaggcctagagtctttggagtcttgtacatgggtatttaatctcctttgtctcgagagtttcttaagtttgccccctttaaaaaggtgtgtctctagttttgtttttgaatggccatgaggcttcaagtactggcaggctgggaaccagggaacatgacttaccaagctaggatagtttctcaccctgctgtcttgacagtattttctctgggaggcagactgatttattagtctgctctaatgggtttcattgttcttataaggaggtgttataagtcttcaaaatggattagagaagtaaatgaaagtttagaaataaactttacactcctcctccactcccccatgaatagtgatttttgtttttttgttttagattttaggttataaacagcacatacctaacattaaaaacaaaagtataggccaggcaccgtggctcatgcttgtaatcccaatactttgggagactgaggcaggaggattacttgagtcccagagtttgagaccagcctgggcaacatagccgagaccttgtctctattaaaaaaaaaaaaaaaaaaagtgtagagaaaactgaaaaaactttcccagaggtaacagctgtttttgtttgtttgcttgttttgagagagttttttcagacagtctctgggtttctagtgagttagatacaccatgtttcatttaaccatcttctgttgaccgacagcttagtttgttttttctgctattaaattgtcactgtagcaagccttcttgctcatacatcacagtgcattggaaaagtccattttcaaggtgtgattaagtatctttggagtcaaccaagaacagttgtaatgtggttactagttaatttgagtggtcatctttgtattactagtgctgtgacccagtaggtccttaggaacgattgtcaaatgattgaatgaagaatggcatagattcagacttctggaagataagaagctacttgtgactgaaacacatggggaattgtgaggactgcagaggcagggatctcaaaggaagagaaaggatgagtgtcttaggcattggcagggggaggcagggtatcctctcctaccctcctctgttttcctgcagcttgaggtggggaaggggcaggagcagagcaggaggcagcaagagagcctgtgactgatcaactgcgtcctggctgatcacctcacctctcctctgatcttcaattttctcatcagaaataataagcaaatgggtccttatggatgtcagcctcacagtgtgcttgtgaagattaggggccagctgcttgcagagcctggtacataatatatgctcagcaaacatttgtggactcaagaggcttcaagcactcctgaatctggccctccttacccaatagacttgggaaaatgcttattttcaggaaaactcagatgaaccaaatcctagcaggtccagaagcagaggcatagagtgagtaaattttattcttgatcttctatttggtaagacatgaagtagaaattgtctgttatttactattggggcctttaaatattgaattaccatggctcagtgccctcagtaggacatacaatagattttaataaaatagattttaataaatatttcatatttatcccagatttctcaaaatagtaaaatggaaatttctttgtctagtttccaacttccatatatcgcatatgaatatttatcattttccccctttctatacaaactactacatttttaaagaaactatttagatcttagatggctattggtatttataatcaatctgaaacaataacaagtagttactgtgtgctgagtttggtaccaaacactttacctgtaatagcttaatttttataatagccttatgagctagcattagaattagtccaatttaacaggtgaagcagctgaggcacaattttcctaaagtcatattgttaatgttggaggcaggacttgatttctagaacctgctctgacctattacattaatgtgatttctttctaacgttgataaaataaatcgtatcagtaaaacaatgagtcaaatgactgagtcctaaactaacatacttttactgtattttggaatcatgtaatgtaataaaattccccaactttatgggttcagtgtaatgaattttggtaaatgtatacaattaccaccaccatgatcgaggttaaaatttttttttgcctcactctaaaagtccccttgtccttgaaggaaaccaaaatattttatcccaaaatgtactactatgacatatttcaagatggctgtgtagaaagctggaaatatcagaatagctgaaaagctgccttttgtggaggagatttgcacctgtagagagaatctgtattgatgcagccaggctttctctgaagtcctctcttgttcagatttaggaaagaatcacagagagtctgacacctttaaaggtctgaaacaaatgtttaccaactgttctttctgagagctgctacctgtgggtttcctctgtatactaagaccacttttgcttgccgggtctctcctcttcttcccgtgacctgtcttgccaccataacctgatttgccaccataacctgtttttgaccatgccgcttttttctgtaatctcaagatggtataaaaccatcaactatttggccatttctttgagatcttttattttgtaagactcccgcgcatgttagtaaatttgtatgcctttcctcctatgaatctgccttttgtcaggtggtttttcagtgaagcttcagaggatgaaggggaagtttacccttggccccgatagtctttttgctctcaatccccttcattcagccctgaccccaggcctccaacatctactctctgtcatgcgagttccagacacaggattttgttccagcaagtccccagtaaggtcagcagttcaatcatcatcatcattctcattttataggtaaagagtctgaggccgggcatggtgattcacacctgcaatcccagcactctgggaggccaaggtgggtggactgcctgagctcgggagttcaagaccagcctgggcaacatggcaaaaccctgtctctaccaaaaatacaaaaaattagccaggcatggtggtgctcctgtaattccagctattcaggagcctgaggtgggaggatcgcttgagcctgggaggtggaggttgcagtgagctcagattgcgccactgcactccaacctgggtgacagagtgagaccttgtctcaaaaaaaaaaaaaaaaaaaaaaatgaagagtctgagtagggttgctagatttagcaaatacaaatacaaagtctcccaattaaatttaaattacaaatcaacaacaaacaattttttttagtataagtatgccccatgcaccacttgatacatatttaactgagcatcctgtattttatctggccaccctaagtctgaggctgaaagtttgggtgacctctcccagatatttctcagctagtttttatttctcctattcagtggaggatgtgaaacagctcagaattcttaatctgatttaacacagagcactgtaaagaaggaaatagtagaaaggtcccatctgtgtgtgtgtttggggaatatgagtttatttccagtttattttctgggaagttctgcatcctgatagaatagttttcttctatataattaactgattatttgcttaagaaatgtttactaagtttctgttatatgccacgcattctgttaaattaggactattactttagcatgtgtgatctttggctttaagaattggacttatattttgcatgttggataactgagattgaggggcagtacctggcacaggtgaggtggcctctactccatctcagccagggtatgtggagagctaatgcataaaaactggacctgggttggccaggtgcagtggctcacacctggaatcccagcattttgggaggccaaggtgggtggatcacttcagctcaagagtttgagacctgcctgggcaatggtaaaaccccgtctctactaaaatacaaaaaattagccaggtgtggtggcatgtgcctataatcccagctacttgggagaatgaggcacgagaattgcttgaacccaggaggcacagattgcagtgagctgagatcccaccactgcactccaggctgggcaacagagggagactctgtctcaaaacaaaaaccaaaacaaagaaaagctggaccttgggaagaggtggatgtgtttccatgggctctgctgtgacctgcgccctctgtcatcctcacctgcagtcctgtccccagtgaggctccctcgggctctggcagctttttgaccctctgctgctcagtgctgctcatcttcctgctgtgtgaactggctggccccacattttctgtgcctttagataaacaaaaccagtttgatttatgcccctgctcttgctggcaccaccctgcccaaatagatttaaagaaatctgtgagggaaacatttaatcagctcattttgaccaagttacagatgaggccatcctgtgtaagtgatatggggctctgtgaacagtgatatggggctctgtttctttgcactctgccagcatcagacatggcaatggggacaagttgggaaagcttgcaaaggacccgtcagtaggaggggagggctgtgcagcctgtgtgcgctggttcagttgtcctccctgccaagtgctgacccaacttggctgcttcccctctgacctaacctgatctcctctttccctacccatacctcctgttcctatcaggctggcccactctttgtctctgcctggctcacttcctctgcctgggatgactcctggttttagtctacctgtcaagggagcaatcgtttctcaaagcccacctcagtcccatctcctccaggaagtcctccttgattgcatgagatgcctttctctgattgctgtgccgcttcatgtttcaaccttgtcatgctccttcctctttttgtgtttatattttgtctcccctgattatttataagcaaaatccaaatatttgaatgaagggacagaatgaaggcttgtgggtatggaacacccagcatggaattctgccttggtagttgcttagcagagatttggtggaaaaggtgatggtgatgatgatgacagcagtgagaagactgagtccatcttctgccagtcatcagcttggatgtcctagttttaagtcacttcatctccctgagtctggggttgctcccgctcaaggttcatggtgctgaggatctgtctacctcgtagtgctgttttgaggaacaaatgggataatatgcaagctctaggccatgctcttaggtgctagatgccaccacccagactctgagctgtggccctttatctggtgaatttgggtttttaactacaaggggacttggagaggtgggaagaatgagtcgacattagaaacagacaccttttgtgtctgtaattctacttgtcccaggccatcaccattttggcataggtataggggggtgtgaatgcagtaaggtgggggaagtaggtgacattttcaactggcctgtaaaggcctcttcatgttaaaaggcagagctgtacgaaggggtagttggtacaggagattgttctgggatttttttgtttgtttctgttttgttttgtttttttgagacggagtcacgctctttcacctaagctgcagtgaggtggtgcgatctcagctcactgcaacctccaccccccccaagttcaagtgattctcctgcctcagcctcccgggtacctgggattacaagtgcctgccaccacacctggctaatttttgtatttttagtagagagggggttttgccatgttggccaggctggtcttgaactcctgacctcaggtgatctgcctgcctcagcctcccaaagtgctaggattacaggcatgagccatcacgcccgccctgttctggggtttatgaaaatatttgtcagatcacagtcttaaaaaaaacccacaatactccaaacaaacaaaaacaccacataataaaagagcagaacagatatgttttccttttgatctctttaaacagttttttgaaagacaggtagggctgaactgtagtaccagatacttctcagtacgctggtggttttgatagctcaactgtgtactgagacccatggaaaaggtcctcttttggtggagttgaatttggatttgattgttgacttttggcacatttaactactcagtttcctttatgttcattgtcccccttaggtcagtatccgagaagggaggagaaagattccttgacaagtcagctcaggttgtaaaaacctgctgggaaggtttctgctctgtgataggtattagaaccttaatccttgttgatttttccccagatcttggcctcagggcttccccaagatactgtcttgcagatggataactcaggcagccctgttgattcaaggctgctgtgattagaactgattcgggaacatctgcgacatttacgaacacatgccaatgaagacaatggccttttaaagatcacttaatcagttagccaagaaataattgcatgcaaagaagtcaaatttttgcttctatttaatggaattagcagagatgggtgcatcaatcccaggttgtttcagcagccctgcctgggataatgctccaactgggatgccttttgacagtctctggaagggccgaaaaatttccttgagtttaaaagaaacagaattgtctttataatattttgtttgtttgtttgtttgagatggagtctcgctctgtcgcccaggctggagtgcagtggcgcgatctcggctcactgcaagctccgcctcccgggttcgcgccattctcctgcctcagcctcccgagtagctgggactacaggcacctgccaccaagcccggctaatttttttgtatttttagtagagacggggtttcaccgcgttagccaggatggtctagatctcctgacctcgtgatccgcccgcctcggcctcccaaagtgctgggattacaggcgtgagccaccacgcccggcctataatattttatactaggtttaatcgtactctagcctgggccacaggagtgagaccctgtctcaaaaaaaaaaaaaaattatactaggtttagatgagagattgcaaacttaaatggctacaggcaagtaccatacatatatatatatatatatatatatatatatatatgcgcgtgtgtgcgtgtgtgtgtgtatgtgtatatatatatatatatatatatatatatatttttttttttttttttttttgagacaaggtctcactccagtggcccaggctggagcgcagtggtgtgatctcggctcactgttgccttagccttgaagtctccagctcaggttattctcccacctcaacttcctgagtagctgggactacaggcacatgctaccacacttggcttaattttttgtatatttagtagagacaacatcttgccatgttacctaggctggtcttaaactcatggactcaagcaatctgcccacctaggcctcccaaagtgttgagatgacaggcgtgagccaccgcagccaactggcaggtactttaaatgagagatgaggatcaggtgaacaacagtggagagtggtgggaatggtttaggtcccctcaccagacagttgcctgaatgtgaacccattgattccagatctcagttttccagagaagccagaacatcagtttttttttaaataaacttaatttttgaaacagttttagttttcagaaaagataggacagagggtttccatataatccacagtttcctctattattaaggttttatattaatatggtgcattcattacaattaacaaatcagtattgatacattcttattaactacaatctataacttttcagacctccttagtgtttacctaatgtcctatttctcttccaggaccctggccagtgtaccacattacattgagttgttaggtctccttaagttcctcttgtctgtaacagtttcttagattttccttatgtttaatgaccttgataattctgatgagtacttgtcagatattttgtagaatatccttcttggaatttgtcttatattttttacataattagatgggggttatgggttggggggatgaagaccccagagataaagtgccgcactaatcacatcgtatcaagagtacctactatcatctgacttacactcttgatgttggtcttcatcacctgggtgaggtagtatttgtcagttttctccactgtaaagttactcttttgtcctctctttccatagtatcctctttggaaggaagtcactacatgcagcccacactgagagtggggatttatgctccccctttttgagaagtatctatagaaattatctgatatggctgggcgtggtggctcacgcctgtaatcccaacattttgggaggccaaggtgggtggatcacctgaggtcaggagtttgagaccagcctgaccaacatggagaaaccccgtctctactaaaaatacaaaattagccaggcatagtggcacatgcctgtaatcccagctactcgggaggcgaggcaggagaattactcgaacccaggaggcagaggttgcagtgagccaagatggcaccattgcactccagcctgggcaacaagagcaagactctgtctccaaaaaaaagaaaagaaaagaaaagaaattatctgatgttcttctgcacaagagatttgtctagtcgctcctatttatttaaaacaagtctgtaaggactcatggatattcactttatactttgggtcatatttcactactacttggttggtcaaattgttccatcttggcccatggaagctctttcattttgctccttgtctctgacatactcccattcctgatttgtttttttcatttgttttgaatgtttccttactttctggagctacaaggtactccaggcccatcttatatatttcctgcctcagtcctagaaatcagccatttctccatagatccttggttgcactgattgtagaatggtattgcaatctaagatctgggcactagatatgttcattgttactggagtgttgttgcatctaggtcctctcagctgacagagcaaggaaatatatgtgtgtatacaaacccatgtatacagacacatgaataaatatttctatatgtagtcatctatattaaactaaacatgtggtcatactaatatattcaactctagtgcattaccacatggatcattctagcctcttccccttatgtgtaaactgccactacaacagttggaaacctgactcccactatctgccattcatttacttgtttgattctgtatacacatgtggcagtatagtgctgttaacctatactcctgtggaaaacaactttatcagccagagtccaatgcctgtgtacagttagtttctttgcctttagtttacagactccactcattttcaaagtgacttaggtcagcactttttttctcaccacgttcagtgagttggtttcatacatttgtaacatagttttatcacattctacattccatcctcggattccccaaacctcctaaattatttctaaaaatatttgcaaacacgaagcttctgttgtaaagttcagaaaacatcaagttctgttgtaattttgactaatgcatagtgtcatgcatccacaattctagtttcacatagactagttttattgccctaaaaaactccatgtgtttcagttattctgtacctccctgccccaaaactttgtggctgttgatctttttataaagtctctatacttttggcttttccagaaagtcatataattgaaatcatatagtatatagcttttccagactgactcctgtcgcttagcaatatttatttacgtttctttcatgtcttttgtgttttgatatcttatttcattttatttctgaataacacattccattgtatggatatatcacagtttgcttatccattcacagactgaaggacatctttgttgtttaaattttgggggttatgaattaagttgccataaacattttgtatggacagttttcaaatcagttgggtatttatcgctggattatagagtgagactatgtttagctttgtaagaaattgccaaactgtctttcaaagtggttgtaatattctgtattctcttcaagatacaagtttttaaaattttaagtcacacaaataactgctggtaccaaattccagttatctaaaaatcaaacaaccaaccaccaaaaaaatgcatcagggaagtgtgttttgcccacgggcaggcagttaataaccattccagatgttagaccaatgtttcccaatagaacttttgtgctgatggaaatgctgtatatctgctttgcccaactcagtagcaaattacaatatttcaagtggctattaagcatttgaaatgtggctagcaagactggagattgaattttaaaatttcaaattattttaattatgtttaaatttactcacaggtggctaatgccaaccatattagatggcacagttctaggtcattgtaagaattttgggtttacttgagtgagatgagaagttgaggatgattttgagaaaggcagtggaatgatctgacttacttttcttattttaagaaatgataaagtcttgctctgttgcccaggctggagggcagtggctagccttgaactcctgggctcaagcaaccctcctgcctcagcctcccaagtagctgggactacaggtgtgcatgactgcacctggctgacttacatttttaaagtatcactttaggctgggtgcagtggctcacacctgtaatcccagcactttgggaggccgaggcagccagatcacctgaggtcaggagtttgagaccagcctggccaacatggcaaaaccccgtctctactaaaaatacaagaattagctgggcgtggtggcacacacctgtagtcccagctactcaggaggctgaggcaggagaatcacttgaacccaggaggtggaggttgcagtgagccaagatcatgccactgcactccagcctgggcgacagagcgagactctgtctcaaaaagataaaataaaataaaaataaagtatcgctttagatgctgtgttaggaatagactgaaggagtcacgggtagaagcagagagacttgttggaaggcgattgcaataatctagaaaagagatgatagtgacttggaccagggtgatggtagtgggcatggagagaagtcatgagattcttgacttttctgaagttagggcctgtctatgcaaggtaaatatttgtcagatactcactgtatttgtgacaaaggccatggaattaaaaaatcttgctgtttgcagcctcatttttcttattccatctttcattttctttaagccactgagtatggtaatagtaagatttcagccctcctgctctagaggtaccatgtcaaaacctgattgggtttctgagtggtttcctttctcttattttcaggagaatgaatctgtgccttaccttcaagctgccactacaagtgttgggctggaataaagatgcacatttttagttcttaattttaaaattattttttatgcatccactttttaggttccataaaaataattactgccatggtcatgggtcatatatgagtaagtgggagagaagggcctggctggtttctacttgggatcatatgtcagccttattggaattctgtaaccagcactggtccaatagaaatataatgtgagtcacccggccgggtgtggtggctcacgcctgtaatcccagcactgtgggaggcagaggcaggtggatcacctaaggtcaggagtttgagaccagcctggccaacatggagaaacactatctctactaaaaatacaaaattagcctggcctggtggcaaatgtctgtaaccccagctactcgggaggctgaggcaggagaattgctcgaacccaggaggcggaggttgcagtgagccaagattgagccattgcactccagcctgggcaacaagagtgaaactccgtctcaaaaaagaaagaaagaaagaaagaaatatgagtcacctgtgtaatttaaaattttctgataggcacattaaaaagagtaaaaggaaacagatggaattaattttaataatatattttatttaattcaatatatccaaaatattatcatttcaacatgtaatcagtataaaaaattatcagcgagatattttacattctcttttctttgaaatttggaatgtattttacacctacaacacatctcaatccaaactagcgacgttcaagtgctcattcacaacaggtgactggtggctaccgctttaggtgacacagctgtaagcatttgtcaagttcagatttggtggcggtagggctgaggaatttaattcccgttgtaattgatatcacagacactgttgtggaatgaatcaagataatattgtatgatgtgagcagtggctagtcttgtaaaacaaatgaaaaataaaaatacatctcagctctaccaaacttagactggagctgtcggtctgtgatatgtctagtaatgtctccagaatatatactgaaataaattcctccttaagaaaatcagattgtcctcttttccccctttgggctaccaggaaagcttaatttgaaataaagtgctgggatgggacttgccctaaaggagactttagtaatctcatcaaccctgaactggcggctcacctgccttaactgtgtttcctggatctttcagctaaggcgggtctttggaaattgcctgccacccttcccaccaaagtactatctggcaatgaccacagctatggctgatgagaggagggaccaactggaacaatatttgcaaaatggtatgtatttgcagggttttttaaaaaacagatttattgcaatgtaagctatatgccacaaaattcacctgctaaagtgtacaattcttttacaatatatttatgtaattaattgtgcgaccattaccgtaatctaattttagaatattgtcactacccccaaaagaaacctcatacccattggcaatcacttcctctttccctcccccaccacgccctggcaactaccactataatttttatctctaaagatttgcctattctggacgtttcatatataagggattatataatatgtgttctttgtatttggttttaaaaataccttttttttttttttttaagagatgaagtctggctgggcatggtggctcacacctgtaatctcagcactttgggaagctgaggcaggaggatcacttgaggccaggagttcaagaccagcctgagcaacatagagagatcctgtctctaaacaaaattttaaaaattagccaggtatgatggtgcatgcctataatcccagctactcaggaagctgaggtgagaggatagcttgagcataggaagctgaggctgcagtgagctgtgattgcaccaccgtactccagcctgggtgacacagcaagacagtgactctaaaaaagataaaaataaataaataaataaataaaagagatgaggtctcactatgttgcccaggctggtctcaaatttctgggctcaagtgatcctcctgcctcagcttcctaaagtgttagaattacaggtatgagccaccacacccagcctaaatgtctcagcagttatatgtttgctgattttattttttgagacaggatctttccctgttgacgaggctggagtacagtggcacaatcgtggctaactatagccttggtctcctggggggtcaagcaatcctcccaccacagcttcctgagaagctgggactatatgtgcaacgcaccatgcctggccaattaaaaaaaaaaattttttttacagaggtggggtctcactatattgcccaggctggtctcaaactcctggcctcaagcaatcctcccatgtcagcctcccaaagtgctgggattatagatatgagccactgcacccaatatttaattttttttttttaagacagagagacagagtctcgctctgtcgcccaggctggagtgcagtggtgtgaccttggctcactgcaacctctgcctaccaggttcaagcaattctcctgcctcaccctctctagtagctgggattacaggtgcttgccaccatgctcagctaatttttgtatttttttagtagagatggggtttcaccatgttggccaggctggtctcgagctcctgatctcaaacgatctgcccacttcagcttcccaaagtactgggattacaggggtgagccaccatgcctggcctactttatgtttagagtcacacttgggtgctgtattttggctttgattgggaggttaaaaaaaaagtttctggattaggaatgaacaaaaggatgagatgaaccacttacaggaaagcccttgagagatgtcagaggtctttattagcagtgccagagcttgtgccttcatgttagtccttaccaggaagccatgctaaggcaccaaggacattcagctgtgtcccctgtgaggcttacagtacaacagcttgcccttcgcctgggtcctagaaatgctgtgtacagcaaaactgttgttggcaagattaggctgtcacggaaaagaggatgttgaggggaaatggcaaaactggcacttaaagacttaaagtttttaaaattggaaaagtgtatacacataatatttcttaaaatataaactacctaaaagaatatacaatgaaaggtaagttccctttccaccccaggctgtttgtatattacctagcagcaatttgcgtgtatatagatccctttttgctcaacacaaattgaactttactatacatacttttctgtagctgattttcagagctttttattctgaaagtttggtttacagaaaagttgcaaacataatgctaagcatttctgtatacgccacccagatttcccagatgtttacattttacatttgtcttatcattcttttttccttgtgtgtgtatgtgtatatatgaatctctctatatcttttttttagactcacttgaatcttacacacctcagccatcttattttaagatactttgtgactttgggaggctgaggtgggcagatcatctgaggccaggagttcaagaccagcccggcctacatggcaaaaccccgtctctactaaacagacaaaaaattagctgaccatggtggcacgtgcctgcaatcgcagcaaattgggaggctaaggcaggagaatcacttgaacccgggaggaggaggctgcagtgagccaagatcacaccattgcactccagcctgggcagtgagagtgaaactccatctcaaaaaaataaataaataaataaaatactttgtgtatttcctaagatcacagagactgtcttatagaaccacagtatagttagcaaaatcaggaaacaacattgatacaataatgttcaatatatcaaaaccaggaaacaacattgatacaataatctatctagagaccttattcaaacttcaccaacaattaggctcggcatggtagctcatgcctgcaattccagcactttgggaggttaaggcaggaggatcccttgagcccaggagttcaaggccagcctgggcaatataacaagaccccatctgtacccaaaaataaaaaataaataaaaattagctgggtgtagtggcacgtgcctgcacctacttggaaggctgaggtgggaggattgctggagcccaggagtttcaggctgcagtaagctctgatcttgccactgcactccatgctgggcaacagagaaagaccctgtctcaaaaaataaaataaagtcagcaaacataaaactgctgagacatttaggctgggcgtggtggctcacacctgtaatcccaacactttgggaagctgaggcaagaggatcacttgagcccaggaatttgagaccaacctgagcaatatagatctcatctctgtattttttttagagtcagtgtcttgctatgtcacccaggctggggtgcagtggtgcaatcacagctcactgcagtctcgacctcctgagctgtgatttgagcaactgcactccagcttgggtgacagatggagaccctgtatctaaaaataaataaataaaacatcgccaactattatactaatgtcctttgtagctcaagaaaaagggtttttctcctgtatgttgacttttttctcttaaaaaatatatatcttagaagtcattctacatcagcagtcatagatttatctcattatttttcatggctgcaaatttttcttaaacatagtaagtaaaaattctagaagccatctatttcccattaaatttttttttgtcatgggaccatacttctttttagacctgctgaatgagctctttcaaagttcaagttcaaaatgtaatatcttttgaattttcactctcccttagtttgttttctcgtgtcttagcaaaatgttcctttaatacctggccttttcacagatgatcaccgtgcttgagggttcgcttttccaggcctggtctttattcatattatcaggatgacctgtgtaccgtctttgacaaggtccagtaggaagacagtacagcttagcctcatgactcagagcacaggttctcaaatcagacccagtgtcaaaccccactttagctcctcaccagctgtgtgaccttgggcaagatacctaccttctctgagcctcagtttctttatccgtgaaacagaaataatatttacctccgagtttgtcatgaagattagataagctaaaatatacaaagtttttagcctaatactggtacttaatagtcacgcagtaaataccagttgggtgaatacctttttcagcagctttcctcattcccaagaatttatgctaatgaatatagttattagtagtttgactatatgccccattgcagaaaataatgcaagggcttcccctcctccactccgggaattacccctcagaaaagacagaatgctttttataaatagtttctcatgttgcagggactttctctcttcgtttattttggaaaacatgatgtcttttgggaaaggcacagcctgcaatgaagtcagtgatagttttgaatgctggtagaggatgtttgataaaattagtaaaacaggccgggtgtggtggcgcactcctgtaatcccaaaaacttgagagactgaggcaggagaattgcttgaacctgggaggtggaggttgcagtgaggtgaaatcacgccattgcaccccagcctgggtgacagagcaagactccatctcaaaaaaaaaaaaaaaaaagtaaaacagcaatgaaaacagaaggaagaaagaaatttggcagcatttagtaagtatgtaagtgtagctgaagcgcaggatataggagaggatctgtggcaagtgggggtaaaccaggaggaaccaggctgggccataccttgtgggtttgcagttctcatgggggtgtgtctgccccatctgctctgcccatatctcctggctatttgtgtcaggagctttaaaactaagggtaaaaatatttttgttaattatagaagaatgaaatattttaaatctctctgactgccttatcattgcttttttttggtaacatctcgagaactcctatcattcaaaggggtgctctcggccgggtgctgtggctcacacctgtaatcccagcattttgggaggccaaggcaggcagatcacctgaggttgggcatttgagaccagcctggccaacatggtgaaaccccatctctactaaaaatacaaaaattagccgggcatggtggtgagtgcctgtaatcccagctacttcagaggctgaggcaagagaatcgtcttaacccaggagacggacattgcagtgagccgagctcacgccactacactccagcctgggcgactgggcgagactccaaagaggtgctctcagttgatgtttcttggttgaattaaattttcaaattaccctgtgtcttgctaggctgggagtctagatgcaggttttaagatctttctgattcttcatataaacttcattatcatcctggtagggcagcaaaatggatgttcagtagtatgggtttgtataaataaagtgagatgcctgggaacactgtcaccctggatgggtgtcatgggttcctgttgttaaggctgcctataggaggcaagctttgggggttttcctgtatttgagaggtttcaacatttatcacttcagggaggagacagagcactggcaaggcatggagggatctctggaggacatagcaattaataggcagggcccagcccagcccatgctaacctggctcaccgtccatgtttttcagtaaccatggacccaaacgtgttgagaagtgatgtcttcgttgagtttttaaaactggcgcagctggtaagcttgctcttctttaatggggccatcattcctctgcaggacactcttcatgaaccaagtgtgcaggtacacacacatgtgtgcactggtcacagccccacagagcctggacttggacaaaatatattcatttcaagtcaattgggggatggttcctattttgttcttttggaggtttagattttagatggaaaatgaagtgtgtcacttgacctttggctcattttattaagtagatccctttttctgtagcctaagaatcatacatctcaaaacaggacatgaagaagaggaccttcaagtacagtacaagaactacagcctttatcattaagggttcccataacatgtctgtgaccctgcttctgtagctgagatttccaaatgggccacagtgaagacatcaggaaagcaggccatgctggctattccttgtatattctctactcctacctttattgtaaatgaatcatggagaaaattcaacatgaacagaatgacatacagcaactccctttcctttgttggtctaaagagtcatgggtcacttgctccctaggctgaaactgctaagtacgtttgtttagcacaacactcattctaatgacacataaggaaacattgttatgcctgtatgtatgagcttggctggaaaagctctgaaagaatttaagttccgcagtaatatgatactagttaactggatccttagccaggggaggaatgatcagatttgcaaaaatgagaacacatttcattcattcatttactcatttataaaataaaatcccattgggttctcacaacaaatctcatgtaaacaggggttcaaatgtgttggaatatttactggcccagtcaacctgagaaatggccctagagccttctgttctgtagtggttcatattttcacaatttcttgatggtttatatatacacacactttcctattctttgaaaagtttgctgtggaagtggtgatgatagtaaaattcaaatagccaagcgtatacaatgaaaagtaacttttcttcccttatgatccccctcctcagtgacaactgttgtgtatagtctaatagtttatagtgctcttttgctacacatttctgcacatatataagcatgcatatatatacatatatatgtacatgcacacatatatatacacatacatgcacacacacaatcatgtgtcacttaaaaatgtggattcgttctgataaatgcatcattaggcgattttgtcattgtgtgaacaccacaaacctagatggtagagcctactgcccctaggctacaaacctgtatactatgttactgtactgcatactgtagacaattgaaacaccttggtatttgtgtatctaaacatagaaaaggcacagtaaaaatatggtactatcattttgtgggactactgccatatgtgcagtttgctgttgaccaaaatgtcattaaggggtacatgactacacacacacacacacacacacacacacacacacacccattttattttacaaacaagcgcacactcaacacattttttcaacttgcttttttaaaaaaattttattattattatactttaagttttagggtacatgtgcacaatatgcaggtttgttacatatgtagacatgtgccatgttggtgtgctgcacccattaactcgtcatttagcattaggtatatatcctaatgctatccctcccccttccccccaccccacaacagtccccagtgtgtgatgttccccttcctgtgtccatgtgttctcattgttcaattcccacctatgagtgagaacatgcggtgtttgtttttttgtccttgcgatagtttgctgagaatgatggtttccagcttcatccatgtccctacaaaggatatgatctcatcattttttatggctgcatagtattccatggtatatatgtgccacattttcttaatccagtctatcattgttggacatttgggttggttccaagtctttgctattatgaatagtgccgcaataaacatatgtgtgtgtgtgtctttatagcagcatgatttataatcctttgggtatatacccagtaatgggatggctgggtcaaatgatatttctagttctagatccctgaggaatcgccacactgactcccacaatggttgaactagtttacagtcccaccaacagtgtaaaagtgttcctatttttccacatcccctccagcacctgttgtttcctgactttttaatgattgccattctaactggtgtgaaatggtatctctttgtggttttgatttgcatttctctgatggccagtgatgatgagcattttttcatgtgttttttggctgcataaatgtcttcttttgagaagtgtctgttcatatcctttgcccactttttgatggagttgtttgtttttttcttgtaaatttgtttgagttcattgtagattctggatattagcccttgctttttaatgcccgggtgctgtggctcacgtctgtaatcccagcactttgggaggctgaggtgggcggatcacctgaggtcaggagtttgagaccagcctggccaatgtggtgaaaccccatctctgcaaaaataaaaatttagccggtcgtggtggtgcatgcctgcaatcccagctacttgggaggctgaggcagaattgcttgaacccaggaggtggaggttacagtgagctgagatcatgccactgcaatccagactaggtgaaagagcaagactctgtctcgaaaaaaaaatttttttaaattgacgttgctcttttagacctatgtcttgcagatcattctatatctgcacatgtaatcgtaagttgactttagttcagtcgtctttttggggtgcattctgggttttgctttccatcattcatgggatcattcaatgttgttaagctttgttttgtatatctctgtttgtttgtttgtttgtttttgagatggagttttgctcttgttgcccaggctacagtgcaatggcatgatctcggctcaccacaacttccacctcccagtttcaagtgattctattgcctcagcctcccaagtagctgggattaaaggcatgtgccaccacgcctggctaatttttgtatttttagtagagacaggattttaccatgttggtcaggctggtcttgaactcctgaccttgtgatcttcccgcctcagcctcccaaagtgctgggattacagacgtgagccactgcgcccagccagttttgtgtatcttattttcctgataatttgaaaggttttatacctgatttcatttccttaatattttgcctttgtgacttcatacaaaagccttatacctctagctgtgtttttcagtgcctctttttactttttctaacacaattttcacttttgtaatggctttattttcctcttccatttcttccgtgaactttaccagctcacttttatatccttttgttatcttatttcttgaggcttttatctattctttgaggtcttcattcagaaacaccttctttttattttcatctgcttaatgatgtaattcttttggtatatgttatttgcctttcattggtcatgtttctttcctcctttcttgcaggatttttgcatagatcccttgccagttatctttaagtcatcaatcaactttgaaacaggctgctgttgtgagctagctgtttgctgacacatagtactggggagggggcctgagttgaattcatcgaatctgttgtatttccagttcttgtttcttgtttctgagcactttcttatgaacatgctaccctaaggcctaatcagactgtctagcagcaaagctttaaaccccagctcctcatatcatgatctagccttctaaatattttgattgactaagatcagcagcccccgacctggtctaggggttaagagttcaggctaagtagtgagatggcctcagttcaaattttggctgccctacttttgatttatatgacttgggtcaatttacttaggctttttgtacctcagtttccccatctgtaaaatggggagaagagctcctgtctcttggggttgctttgaggattaaattaactgatacccttaaagcatatcatccggcacaatgttaatagatatgaggtagtcactaccttcacctcctgggttcaagcgattctcctgtctcagcctcctgagttgctgggactacaggcgcatgccaccacacccagttaatttttgtattttagtagagatggggtttctccatgttggtcaggctggtcttgaactcctgacctcaggtgatctacccatctcggcctcccaaactgctgggattataggtgtgagctaccatgcctggccaagatataggttttaaaaagcaaaatcttaatgccagtcccttttctttccccagccatgctgagagattgctttttgcaaagatggagtgtctgtacatctcttcagcatcccctgccactaggtggtgtccagtggggcccggagtagcgctctcagacaggctgagcaccatgtgattaactgctttgaggcagcttatgcgttgcttgagttctgcagcactttgagacctctgattccctccttcctgaccaggttcaattttcaacgcacttggcagcccttctgaaaacctcaggctcagggctatttgtaagtttcttcaaggatgctttccttttcattgttttctgtttgcttctaaagagagggcaggacagaggtaacagtcacttcccagaaccttaacacttttcaaaatatgtgctctttttgagttgaattgagttgaatttaacaactggagaaatcttttaatttttcaaggagatcggtgtgctttgttgctattctgctctgaggcagaggaatgtctaatagccatggtgcgcatccaagaaaatccatatgtggactcaccaggctctaaacctccatcacatgcaatgatgggccgctgtcatttctctacaagggaaatggaaaacattcttaagaatgttcctctgcctcagagcagaatagcaacaaagcacgtattttaaaacattaaggcagcccatggtattggaggattttgaggtttctttaaaatgaatgtatttttgttagttttctagtatgaattgcattttttcattcctgctgcattatagataagtatggcagctgggccaaacgtggtggctcacacctgtaatcccagaactttggggggctgaggtgggagaattacttgaggccaggagttgaagaccagcctgggcaacatagtgagactctgtctctacaaaaaaataataataagagatatttagatgggggtagtggcacgtgtctatagcccccgctactctggaggctgaggcaggaggattgcttgagcccagagctttgaggctacggtgagctatgatcagcccactgtactccagcctgggaaacagagcaagaccctgactttaaaaaaaaagaaaaaggatagcagctcatttaatgttttgtttttttatacaagccaattctaccaggttgacttttccccccagctggtttttgtattgcgtttacatttcattaattttgtgaattatacattaaaacattctagtaaaattcaaatatcacaaatagagccaaattgttgtttgatttccactctaaacttgtttgatctgttttgtgcttgctttggtctcatcacaccaagatcttttgatgccatcaattctcctctttattatattgctctaaaatgtttgtttacttaccaaagcaaaatgtgcttatagttagaaaaatgaaatagacatcatggatggaataaaagttaaaaatctaaaaatagcagtgaaatagtgattaaaaggattataacactcccctgtcctccagaggcaatgactttcaaatcttacagctttctcttcagatacttaaaaatatggaggttaattatatacatatatgactatctctcattcttcgttttatttttttctagatacaggatctcactatgttgcccaggactccatctcctgggctcaagtgatccttcctcttcagcttccccaggagctgggattacaggtatatgccatagcacccagctattattcttcaatttttagaccctatccactgactgtgatggatgtgaggatttcagctttcttgtgtcacttctattcttcctttctcccctaactttaattttaaaaaattaagtcctgagtcaacaccttcctctttcctccccgcatccccccacctcccccccaactggagttaaaactgaatcacttaacagaaaaaaaaatgcttagttgtctcaaaacatatgactaaactccttccgtacctatagcagccctgaagacagaattttccccatagtcaagcacatcagtttctttcccttcgagatgatctacccaaagtctctgactttctgttgcttttgatgacagagacttgaataagtttgctgctggtgagtaggagccggtagagaaggagaagtggaagatgggagtgtgaaggaggggccttgattatcagtggctccaagtccttctggaaggagaattgcacaaggtctgggatcaggtggaggaagggcaccttttaaattgagtgtaggtcaaagaaagatagagcaaggctacaggcagggtccaaggctggacagtgaggggaagcagagtaagttcccatcttgctgttttctctgtgactaataggaagtgaggttagctggtgggaaggagggaggaggagagtgtggctggagtcctggggaaagtggatgaggttgaagatgaatgtgagtcagaattccactgggtgagggaactgtttggatttctgttctcccccaaatcccatgttgaattgtagttcccagtgttggaggtggagcctggcgggaggtgattggatcatgggaggtttctcatgaatggtttagcgccctcccccttgttgctgttctcatgacagtgagtgagttctcatgagatctggttgtttaaaagtgtgtggcacctccacccacccttgctcctgctccagccatgtaagacatgcctgcttgcccttcacattccaccatgactgtaagcttcctgaggccttcccagaagctgagtagatgccagcatcatgcttctgtacagcttgcagaactgtgagccaattaaacctcttttctttataaaaattaccgagtctcaggtatttctttatagcaatgtgaaaacagagaaatacaaaccagtagggtgtgatagaaggtggaaggaaggtgagtgcagctgccaactgatttgtccatcctggccaatggcagcaggttgggtggcgctttaacctcttacctcccttgatgtgcaggttctttactgagaggaggttacctcagccaaaaccagtactgcgacatcaaacaaaacattggaggctttagccttaatattctcttcttacatatctgtaggataagtatgcagtcgagggctagagagggaagttcatgtatcaacactccatttttaaatgcccccatttaatttatttttatttttatttatttatttatttatttatttatttacttatttattttttgagagggagtcttgctctgtcacccaggctggagtgcagtggtgcaatctcagttcactgcaacctccgcctcctgggttcaagtgattctcctgcctcagcctcccaagtagctgagattacaggcatgtgccaccacgcccagctaatttctgtattttagtagagacagtgtttcaccatgttggccaggctggtctcgaactcctgacctcaaatgacccacctacctcagctgggtcccaaagtgctgggattccaggcgtgagccaccacacctggaaaatgccccattgcggacgctactatgctagttctttttctcttctcacttggattattttgagaaatatggaaccaagattattaaatgtctacttgtacagggcactcttcaagataaactcaccacataatcctgctctgtaggagcttatcttctaggcagccatctaacctggctttaaactaattaagcgtgaaaaaaaagccaacaacattctacaaataagcatttagagtggagaaggtagaactcaactacttccgattagtcaggttattttcattgtcaaggccaaaatcacaaaacagaaatttgtttatttaactaaaaagttgtggaaggttggctgcctcccacttctcacctctaccccaaaccctgctcttctctacattgactttattctcacagagcttccctccatttgcttcaagattagcagccccagctgaaggcgaggaccctgcccttccttccttcttccgagggagtgagaattgcactgagcatcgaaacctggaggacgtgccagacaggaggaggaaaggaagtaaggggcagtgggccaccaattcctctcatcctgaccaatggcaaagagtcgggtgacctatgaataatgttaggatgttggagggttttaagcaagaaagggacatttttaggtttgcatttaaaaaatatatctcaggctgctgtgtgaggaccacttggtaggggaggagaatggaagcaaggagacttgtaaggagcccattgaagtggggagtctagggcagaggggatgttagctgggtctaaggtgctggtggtaagatggagatggtctcaagagatcatttaagatgggaaatatggaggtttcagaacttgactggatatgagtgttgaaaagacttttctgaatctttctttgactccgttatttcttacctgttgccagtaagtcaaatattaactctcttctacatggagagaggcagcttaacacatggtagcttagagctagggcagccatatagcttatccaaactgggatgcttttgagagtgaaaagagtgctgcagttatcacactggggtgccaggcttctgggccagctgggagagatgtttaccctatttagaacctacagtcacatggagctggccttgagttttgcctctgccaccaactagcagtgtgtccttggataagttattttttggtttttgtttttttgagatggagtcttgctctgtcgcccaggctggagtgcagtggtgcaatctcagcttactgcaacctccacctcccgggttcaagcaattctcctgactcagcctctcaagtagctgggattacaggtatccaccaccatgcctggctaatttttttttaaatgtattttccttttttatttttcttttagtagagatagggtttcaccatgttggccaagctggtctcgaactcctgacctcaggtgatctgccgacctcaggtgatccgcccacctcagcctcccaaagtgctgggattacaggcatgagccaccatgctcggcctgggcaagttatttaacctttgtgaacctgtacttcatctgaaaaaataatgggattagtaagtgtatatgcctcatggagttgttatgagaattaagtgagctgctatatgtgaaacaatgagcccaatgatcaggatcacaatctaataaaatagttgtatacaataaatatatagatattttatccataaatgatgtgctatatacacagcttcttatatatgtagatacaacacacaaatatagtgctttttttggactaatcctttgaatgtagaagagagcagattttctcttctaaagaacttagattcagaatcatagaaatttagtaattgtaagcatgtggtggggaggaattaaaatgtaaagtcaaaacttgccctttgataatgaaatgacgaaaaataagcctgttgctaatgtgatcagccttttggggtcaccgagcaatgtgattgagttgctggggctccccaggtccctgtgaagactgcagcatctgttgtgtctgaaaggtcagggggcctgaggaaaggggagctgttgcccatggtggagacagggtctcacctggtcagctgacctgagccccaactttgtggtcccccagtaatctcctgattggtcatttggatcttcccttttacatgctgacacctggaaggtgatgcgatcaattgtaccccaaacctcagcatcacgcaataaacccgtgtaacaaaactgcaagtgtaccccttgaatctaaaataaaagttgaaattattttaaacatgatacagaatgtgtgcaatgggtatcagatttccgcaacacaaattcaggtgtataccataaatgtattagtcttaaaaaaaaaggaggttacttcccggccgctcccacctgcactgtgtgactagtattctggcttacatagcagtctccaaacacagaagatgatgtgactcctttctccattttcctgaggatgttacatggccagtaccattctgaatgcctaggagagaagttaatttattgtatactgtggatgccttggggcattagagtttaatcctctcagggaatctgggatgagaaaggctgtgacctcaatcagccagagatgaagcaggtctgtggactgacagcatcgcctttaggagatgccaaggaacaatccacccccagatcgctgccctgcaaggccccatgtgggcagccgctggcctctctggatcctgcttcctcctggtgtcctccctctccctatagcagctggagtaacaattcagcctgtgcttccctgaactctgatggcctaacaatgtctccagctccatcccaagaatgtcacagatccccagatttgttcctgcttctagcacacatccttccccttgcaggatgcttatgcttaagcctgcagagttgtgtccagcaggagctgctccttcagctggaaactcactcactagatggcaactcacttcccttcactggcctcacagtttgtgcagctcagatttttgctatagcaaaatcataaattactgcatatttagtgtggcataatacaaaaccaatttgatctttgtccccagttcctggcacagagttcctaggaatttccttagcgttaggactgccttttgttatccataacaagcacctttcaacattgcctgagtttatgctgatgagatgattcttggctgggggactccgagatagtatcaggatgcggactggtcacctgaaagaccacggcatgattagaggattgggactttcagcccccaccccacaactctcggcctcttgggaagggggagtggctggagattgagtttcgtcaccagtggccaatgatttaatcaattatgcctgtgtcgtagacctccataagaaacccctaagcaatggggtttgaggagcttccataacggcacctccataaacaacccccctaagcaatggggtttgaagagcttccaggttggcgagcaagtggcggtgctgggagggtggggcacccaaacagagcatggaaaccccacccacaccttgctctgtgcatctcctccgtttggctgtttctgagttgtagcctttataataagccagtaatagtaagtacaccattttccttcactttgtgagttgttctagcaaactatcaaacctgagagggggtcatggaaaccagaatttgtagtcagctgggcagaaatgtgggtaacttgggccccatatttgctgctggcatgtgaagggggtagtcttgtggagctgagcccttaaacgtgagggatctgatgccaactccaagcaaagcatgtcataattgaattgaattgttggacagccattgtgatgttcaagaactggagaattggttgctacatggaaacaccttccccctgcccccacccacaattagtgtcagaaaaaatcagggatatgggctttagggatgcttggaaatactgaaaactgggcaagttaattatgagactgttaaggatgcagactttatcaaaagctgttttctccaatatagatactcagttgtttacttggaagttctttaagcttcatgttactcctttgccttgcctccactataccccacaaaacaacccttccaatctctgcacttgtctcttgggaactttgggtaccatatgctagaagagcaccaaaaaaggaagctgtggattgttcgcttgctgcaatggtgcagctttaaaaaatggtgtggaggccgggcgtggtggctcaggcctgtaatcccaacactttgggaggccaaggagggtggatcacctgaggtcaggagtttgagaccagcctggccaacacagtaaaaccccgtctctactaaaaatacaaaaaattagctggacgtggtggtgggtgcctgtaatcccagctacttgggaggctgaggaaggagaatcacttgaacccaggaggcagaggttgcagtgagccaagatcacgccattgcactccagcctgggcaacagagtgagactccgcctccaaaaaaaaaaaaaaggtgtggaaatttattttgcttttcttttgcttatagaatacatttgacatcgccaccaagaaagcttatctggacatatttctgcccaatgaacagagtattagaatcgaaattataacatcagacactgctgaaagagtcctagaggtaagctttgtttaaactccagctccagaactgaatctagggatggttctgtttggaaagcagagaatgggatacggttaccttccaggagcttctggcctgttgttttactctgtggatgattatctgcagaggtactggcatttgctgggagaacaaccaaggaacctaagatacagccaatcctccagggcctctttgatttcaccctccctgggggcaccaattttccagagatctcctggaaggctgctgtcacttccttggaacttagccagggatgtggcctggaaatatgtaaaatgctttattactggatgtcccatcgttgggagcaggaaggaaagtggggcttggcagagtctgaaacaggtcatacctaggtgtgcaggtgacaggggagttcttgaaggttcctattctcccacagggaaaattcttgaaaccagtgctccatcagggctaattctgggtgcagagggcccagacatgagttgtagtccactgtctgaggactaataggacaagacccagaaggcttcatccttcttcagcagctctgcctcccagaccccttttccatctgctgagtggggctgcagaggggacactgtcttctcacactcacatcctgctgcctgggggcaagctcccaggcccttttcctctggaaggttttagctctaatcctccagagaaacatacaagagaaaagacaaagttataaacatgaagaagagtcagaaagtttctaggacctttcaaaggacagaacgttcttgtgcttgggttatggtgtctgaccctttctgagctgagaaacggaagcactcccattttggctgctagctcttcgggcctgccttgacttaacctattcctgtatctccagtctctcttatattcatcgtctctccgtttcctcctctcgatcctacatcttgaccttagctccagccctcattgtttcccagctagatctctacagctgcccctaaactagtctccctgcttccagtcttgctaatcttctgtattgatttccagcatagtctttctaaaaagtatcaaaagcccttgatgcttgagggagtttgtaccccaaacacaaaaacctcaattgctcaggatctagaagtgggagacagactcataaatgaaggaggagtaggaaggcagtgatagagtgggagccacagactgcatgtgtctggggccaggcaggtagctctggggtacagctgcaggatcagatatagaacaggagagagcacctgccttccccaaagacatcatcattgacttctttttttacacactgggcttgctgaccaaactagacatgcctgcagctgaagccagtggtggtggtgatagtttggggtctcctatcttctgggtttaggatgagtcctggattcaaattacagtcatgtgccacataataatgacgtttcggtcaacattggactgcatatacaatggtggtcccataagtttatgatacaatattttactgtactttctctatgtctagatatgttttggccaggcactgtggctcacgcctgtaatcccagcactttgggaggccaaggtgggcggatcacgaggtcaggagatcgagaccattctggctaacacagtgagaccacatctctactgaaaaatacaaaaaaaaaattagccgggcgtggtggcgggtgcctgtagtcccagctactcaggaggctgaggcaggagaatggcgtgaacccgggaggcggagcttgcagtgagccgagatcgcgccactgcactccagcctgggcgacagagcaagactccgtctccaaaaataataataataataacaatagatatgtttagatacaccaatacttaccagcatgttacagttgcctagagtatttagtacagtaacatgcctactatactactataaacctgggctaacaggcttgtagcctgggaacagcgggccataccgtctagcctaggtgtatagcaggcaataccatttagatttgtgtaagttcacttcgcagtgttcacacaacaacaaaatcgcctaacgatgcatttctcagaatgtattcctgtcattaagcaaaacacagctgcacagtgttgctgtgtaagggctgtgtgaatttgggtaagttactttacagacaatgtctaagtaaataattatagaaatagttcacgttcccgagacaatggcagttgtgtttatttatcattattggtattggtattgatcttgatattggagggagtgctgaatacgtactgagtagggcagtatctccagggttctgtggtaccatctgttttgtccatttcccttgaaactaatagcatacatttgatgaagtacatttgcagtcagaaaaatgtgcttcctctcttccaatcatgttggcttgtgagaaattcagacccaagacgttgacatcatcagatcaggtaagtttaactggaggttctaccctagaagtggtagtttccataacaggtgaagtggtcacttggtcagccacaggtgtgaatttccttccaggagctgggaaattctctagcttgcataaaaccataatttaagttttataattaaaaatcgccttctgcatcttctccagcacacttgctgccattctcactttgcttccccaggtttgcctcacccacagcctgccttttacttttcaatggtctcttttttggttgttgttttgaaatggagtttcactcttgttgcctaggctggaatgcaatggtacaatcttggctcactgcaacctctgcctcccaggttcaagcgattctccttcctcagctcctgagtagctgggattacaagcacgtgccaccatacccagctaatttttgtatttttttttaagtagagatggggtttcactatgttggccaggctggttttgaactcctgaccttaggtgatcaacccgcctcagccttccaaagtgctgggattacaggcatgagccaccgtgccgggcctcaatggcctctttaagggccagcagcaagctaaaatctaggactactgtggtgctagtgatggcgttcgtgttttgaatcatcattaacatttgctaagaggaaaaatattattacgtatttttttgctgatgctcactcctctcaaaagaaggtgtttatatttatgtctttatgaatgcgaaaggcttcttcattctccttttgcccccatgcctttcctctgtctgccttggcatgtaagcttgttgttttccctgaattagacagaaaagaaggaaatctaacttgagtggacctgggtcaggtttactctgggaaagatgtctttactatgctgttacctaccacacacttacccactgtgtttggcttttgggtgttttgcagcccaaaacatgggggaaagagagagacagaaagaaggggaagggaattgctttgaaagtggtgaaactattcctcagctgctctttattttcaaagctatgctgagaacacccactcataccagccacctaatcagactgcttcctgggggtaatttatgtatctctgacaagagaaggccccctgtgagcctggtatttgtacaactgccacctagagaactgggagtcgtgggtaaagcagctctggagggcagtgcttggaggcctctccttgcgtggtacagaggtgatttagtgagttaagaccaggagtataaagaaattactcgagagcccagtgttaaataggggctgggctgggcagatggcagggaggaagcctgtggtcgtgtagaattttctgctaagggagcgtgagtagatgtccaatgctgtgaggtgacaccctggtaggctgatggtaaaaatgaagccactggcgttgaaatgaaagctgtttgatataagtcaaagaggaatgtgaaggaaggcaacctgtgcctggcatctgaggttttcattttgcaaacatcctagtaaattacagttgaccatcgcaggaaacatcaaggcgaagcaggcctggcgtgtcaaaggtgggcagtagcgcatgcacgtttgtatgccagccaagcggcggggagtgatccttttccaaatagctggtaatgcagcccacaggaaggtaaactagtgtgcaggttccagggacagacatcacagaaggacagatgttcatggaacatggctgctgccctccaggggaaaataaagaccaagacaatccgggagtgagtccacatctgagatgggatgaccaacctcaacttggggccagcctctgtccattgtggtggggctgatttttattttctttattctaatttttttgtgttttaaaattttctaagatggataccattttttgattccaaaaagctttctttgagtgttcactaacccatgacagcattttttattgatgtgtaccggccatttccaagtctgcatgtcacagttaggatgcatggtgggcacacctaactttttccctttctgcttgtttctggttaaaggtggtgtcacacaaaattggactgtgtcgagagctcttgggctacttcggcctctttctcattcggtttggcaaggagggcaagctctctggtaagaaggaaggaacaaatgaatcagctaggagatggggtggacaggtgtgagcaggggctcataggagtcacagctgaggggctggccacccactgggctgtgatccctaccactgttctcagtcactgggttaagggtttagggaataggaggttgcgtccttgttaggggagagtgggggcaaaccgctcataccttgggtggtccagtaactgcacttgtgtacccccagccctaatcctgaccccctcccctttaccgcaggcccggcctgaccactgaccactcgcctgcaccgtttcctgtgaatggagtgctagactccaggggtcaggacgccccaccacagcatcatttctccttgttaaggaatatttgtggatggtatcaatgagttattagattcttttttcaagtgtaatgagatagtgtaagaagacagtctgattctcctatcttttgttttctctacagtatgtttctagatattacaagttttttttttttgtaaaatggtatcagttatattaaagtagtttataaatgtcctcaagaagccaggggaggtggttttgagttggaagttaaggggcttgtgtagagggttggctgctaggccctgcggtgagctgcgaaggcgctggatgtctccggatctattttttcatctatatcacagtgtaaaacaccccccactcaaggggctgtttttttttgaggatcaaatgatatttattttttgaatgaacttcagaaagttaaaattacgtgtaaatacagaggatattcttactgtgattttattatttccaataataaggttttattttctcatttgaaagctgctatatataagctgtctgtgctgtttcaaccagtaagaccggctttctcctttctctagttgtgaaaaaattggctgactttgaactcccttatgttagtcttggaagttctgaggtggaaaactgtaaggttggactccgaaagtggtaagtaggttctgaaagtgacagaggcgtttgacgacacttcgccattgcccatcaggacttaccagagtcccgtcacatcctgctcatagcctgacagctggagaccaagaacttagagaaggctctgagaaaagcaatgaaggccaggtgctgtggcttatgcctataatcccagtaccttgggagaccaaggcaagatgattgctggagcccaggagttcaagatcagcctgggcaacatagcaagacctcatctccactaaaaatcaaaaaaattagccagatgtggtgttgtgcatctgtggtccagctattcaggaggctgaggcaggagacacacttaagcccagaagatcgaggctgcagtgagccaagattacaccactgcactgcaacctgggcaacagtgcaagaccctgtctcaaaaagaaaagaaaagcaatgaaaatgagagagggtgaaataaactggtttctgaatatttgtcctaaagaataggatgttgagggtgactatcagtagtctcaggtaaatactcagggcggggtggggtatgaaaatgaggagggtagccatctttctgcatctctactgataggcgaacaagaaagtaagacttgaaaaccaggggcggggccaggggacatggattaaagcaggtaatggtgggaaatggctggccttgggtttgctttgcaatgcatcactggctgcattaatggagggactttgttgatgattacaaccagatctgatttatccgtagaagtgtggtattccctgaaggtgaagggtggattcagccaggttgcagtgaatttgaactctaagtactgggcttacacatgcctaaaggatgtgtacagggccatccatattcctagataggtaggacacaagtatccctctgcagaaaatactgtcatttcctccagtaacacaggagcctgtggagaacaaaatattatagaaaatagcgctgagcagcaggaccttatgcacccccagtcctataacctgcagctcccagtgtttattaccgtggctgcaggggattgctccttaggctcgctctctcccagcccatttattctgttatctgagtacagaagttttaaagaaaggtattttgaaatctaagaattcccttgaccttgtgatgccttgctctagagctccagtttgtggctttgaattgtggaaggatattcccagcaaggcagttcatatactgctgttcagaagtatcctgaggaatggtccagatcttgagatgtgaaaccctgagaaggggagaagaactcagttccatccaatggtttagagaacagctgttctggaagctgcttgctgtagtgaatggctgagcacagttgttcctggaattacagtatgtgaatctaagttgcgccttgctcaggtcttagctgcgtaaacctagccaagtcgttcaagctctctaagcctcagtttctttatctgtaaaatgggaataataaaaatagtttattggattattataagggttattgcaagagttatgtaaaatagtcccatatgctcagtaagttttggtcatgtttgtgactgttatattgatgatgatggtgattataggaagcaaaaaaaaaaaaaaaatctttggggcttagattttcactcatgtgcgcttcataaaacctgagatcaaaggagagatgatgattctgtttcttaccttgaagcttgaattagaaattaggcattgcctatgtcttttttaaatacgtaaactctagatgatacgtgcaagagaaaacgtctaccccaaattattagccagcatctcagatctaggcagattgcctctgttgatgggaactgggaagaaaggaggttccacttctattgtcagagctgaggatcaggtctctggaggggagattctggcataggctcctgcaggtgccttgccctctttccagagggaagtcttgccgcatgggagctggaaggctagctccaaaagctgagtgattcccagcaggtgaagcctcagtgaggcctaagtggcgtcttaaggacttctctgtccttaaggagagatgcctgggtgcatctctccaatgatgatgatatggcttcctccaggccacagggtacctgtgctggcctgtgggagccccagtctgggatgggtctattctctgcacacaggggcctctgggatgtgtgggtgcatagttacctggaatgtaagtagggatgcttcagttacttctccccaccccagaatgaagttgaccttcaagcaccatatttatccctttcctggtctaagccaaccccattggtctattcaccctattctgagcatagcaactctgcttgcctctgccttctggttggtagagatcagccataggtaccctttcctgacagtttcagtcccttcttaacatgctactgtgcttctacagtcattaatttcagttcctcgtgattctggatctgacaggcagacacggagcccctgctatttgcaaatcactctgtcaagattcagaggggcaactctggataggcccctggccttggggttcttcacagatggtgtcaagaaaacttaatcagagtggcaattggaataaactcagggtgcagaggaagcacagtggacaggcggctaatacagccttggggagtagggaccagaggagggggcactgcataaggcttgcaaagaaaggccaatcagtcaggggaggagactggtgagggccttggtcttccaggcagggagagaggagagaaaacatggttggaatgtagcgttggtggtggggttggtgagagatggaactggaaatgaaagtgggggtggtccccggaagggccttgaaagtgagtagaataaatatctaactccaggaacaatgagagtctgaaaagtttcacaggaaagaccactctggttagaatgtggagcatcagattaagggcacatggctgagacagaaagcctggaaaggaggctcccagagcagctcaggcaagagatgagggtggccctgctgcagggtggtgaatatgggggtaggtctgtgtggggcagttgactatgccaggtattgtgcggtggagaaagggaatccgcatcttggtggccaagagtgaggctgaatgtgaacagggatgcagaccattcccctaaagctttatttttgtgcctctttactcttagagccctccaggcaagagcttacggtgtaaagaaattaggaaacgaaagaggtggaggggcagagtgaaagctgggcaagtggaggtgtggctttgttggaaaagggggccctggttcatagggtagagggccaccactttccaaagcacttgccaggtgtgcccatgggccatgtcacaggaatgaatttcacactcctgaattttgcaggtatatggctccatccctcgactccgtgctgatggactgcagggtggcggtagatttgctctacatgcaggtgagggtcaccaagagctcagacagcaccgtagatcataggccatgttggcttggagccactaaacaaattatgtggcagttagtaattctacctccacacctaaaacaggcacattcatagagacagaaagtagaacagagattaccaggggctgtggggggtggagaagaagttgttattgtttgatgggtacaagtttttgttgggggatgataaaaaaaagtttgagctctaaatagcagtgatgattatccaacattgtgaatgtatataatgactctgaattttgtgaatagttaaaatgacaagttacgttgtatatattttaccacgataacaataaaatgtaaaaagtagaggagtttagagagagaaaaggaattctatctccattgtaacaatccatctctgaatttgcagctgacacactgtcatcatgagcctagaaaggatatccctgataacttaaagtcacacgtgatccttaaatctcactctagcatagccttcttgcccctgagccaacaagcaacctgcctgccattggctccagctgggtgggcatgtggcctgcacagttgcgttgggctctgggctcagagaacccatgctcctgtaatgatcgcggttaccaacttgaaattcttcattttatttttagtttttattttaaaaaattaaattttcattggtacatagtaggtatatatataatatttatgggttacatgagatattttcatgcaggcatgcagtgtgtaataatcccatcagggtaaataaggtatctatttcctcaagcatttatcctttacgttacaaacactccaattatactcttttagttatttttaaatgtacaattaatgttttttactatagtcatcctgttgtgctagcaaatactaggtcttcttcattctatttttttgtgaccattacccaaaatttttaatttttgaacaacattttcattttgcactaggtagaccctgaaaattatgtagttggccctacctactcctacccccagcctctaataaagtaaatttcgagcttggcctcagttcccttctcctgcctcgtgtgatgaagcttcggccaagtcatggaatggtcagccggtgctgccgccaacatacacacccaggtcaccagctgccccaggtgttcacactcaccacaccgccatcttcggagacctgatcttttccaggcttggctccacaattctgggaagaaagctcagaagcttctttcagtgagttccctgagaacatctcacagtctattctcaggcagcaggcagggtggtgggtcacagccctgccctgctccaccccctcccagactttccatctcactcaggctaaaccccaaatcccaatgtccttgttctttttcctccgtagcatttctaccatctgccaatgtaagtatgtgtgtgtgttgtgtatatttgtttactctctccctactggaatgatttctccatgaaagtgggtatttattcattcactgctgcatccccagaaactggaattgttccgggcacgatgtcagcattaagccctttggtgggcctggcatcgtattaattaagtgcgttatgtcattggagcttcataacaactctgtaaggcagttggtaccatccacactttcaggaagaaaaacattagatttgctgccaaaagattgagtagtgggtttggattaatagaggatgtagctaaagaaatttaacaacacttgtttacaggtggcctttatttagcgtgactctaagctgctacactgggtagcttttataaactcaggagagagagagatggtggataagttattacttttaatgagcttttcaagtggaatgttaataaaacctactgtggtactttgggtgtagaaaaaggtcaatgggtggattttgttaccctggcttaccagagggcgtagaagagggaaagaaacttagcccatgcctccttaagtgacttttagagatcaagaccctaaagctcttctaaattctaagagggcaaatcaaaatatcacttattaaatgtttaatgttcaccattgtatttttatggctagaatatagctttgagttcattccgtactatacatgaatccaagtataattatgttcagcctggaaacggggacacacacctgtaatcccagcactttgagaggctgaagcaggtggattacttgagctcaggagttcaagaccagcctgggcactatggcaaaatcccatctctaccaaaaatgtaaaagtcagccaggcatgatggtgtgtgcctgtggtcccagctactcaggaggctgaggtaggaggatggcttgagcccagaaggcggaggtcacttaagatgtgatcacgccattacactccagtctgggcaacataccaagaacctgtctcaaaaaaaaaaaaatcatgttcagtgtacttgatatgagttagagaagaatttttccactttaaatgtttattgaggcccatccttgctactgtatccttgctattatgatacatttttagctgtgtctggtttgataccatgaccttggatgagattgcatcacataattctaatatcgttcctgtgggaaatatcatctttatggcatgtcttttgcttctcattgtgatgagaggtcagagcttcgagcatcataatgtgactttttaaatctgttttcattaaagatttataaccagagggaaacagatgatggtacttcctctgctcaaagctaaaaaaacgtggcttcatgggaggcacactgaattgcagtttcagaaatgaattctgtcccttgctctgacactgatcctctctctgggtgaccctgggccagcaaccgcatccttctgaaccacgacatctccctgttgagatgaggtggaactaacataatctctaagttttctccaagctttaatagactgtcatacaaaccttagctcattgcctggcaaagtctccaaaaaattgtagttgatgtcataataatctttatcatcatcatcatcatcatcattgttccctgaatctgggtagaggagctaagaagtcaaaggtgggtccaaggtcagcaggagagtcaggaccacaatcactgcctcttttgggaggcctgccttggctctccccagaagaaaattcctaccttcctcccacttctcccaaccagactctgaatggccaagggcagagactgtctcattcctcctgtgtcctgggtgtctgggatatgtgaaagactaagaagtggccaggcatggtggctcacacttgtaatcccagcactttgagaggccaaggcaggtggatcacctgaggtcaggagttcaagaccagcctggttaacatggtgaaactccatctctactaaaaatacaaaaattagctgggcacggtggcgcacgcctgtagtcccagctactcgggaggccgaggcaggagaatctcttgaacccaggaggcagaggttgcagggagccaagaatatgtcactgtactcctgcttgggtgacagcacgagactctgtcaaaaaaaaagaaaaaaaaagactaagaagcagtcattctttaaaaaagttaacatgaaaagctcttgagttgtgataaataatggatccatcataattaactattaaggggcacagctttgattttctaaagcagatgtgcccagtgatatccaatgagtcaactgaattcccacagcctgtttcctttcttctgctcctcttttaacctgagtttaaaaatgagagattgcatttaaaactataagtaagtatacattttgaaggctcagtcaattctgggcctgcatttcagcggggccattgctggcctggacagtgatgcaaattagaaaaaggcaccccatcctccaggtggggctagtcctgcatcggggcccatggcttggtgagtggaggggggctgacctttggcttcctgactcccctatggcctggtgaccttgtccaggcacacacgtcccttgcccttctccaccatgctttcgccagagccgagtggccagtgccggcctttgagaggcatatgacctctatttctcactactgtgccctctgcagaggacactagagcgtgtgagactgaaggtcaggaagactatggcttatgtgattttgcttgatttttaaaatttttaattttattatttttttctttttttctatctgcagcacctttaggatgcttgattttttaagttcaattctgcatactcccctctcagccagtgttcagggaaccgtgtaactgagtagacttgtctagactcgactctcattgtctggacctactcagagtgaggcactgtataatatcacatttgagttgatgacttgtgaacccacaatcagggtcaactcttttcaaaggtaatgatataaagctgggcgcagtggctcacgcctgtaattccagcactttgggaggcagaggtgggcagagtacctgagattaggagtttgagaccagcctggccaatgtggtgaacccccgtctctactaaaaatacaaaaattagccaggtgtggtggcacatgcctgtagtcccagctactcgggaggctggggcaagactatggcttaagcccaggaggcggagattgcagtgagatgagatcacaccactgcactccagcctgggcaacagagtaaggctgtctcaaaaaaaaaaaaggccgggtgtggtggttcatgcctgtaatcccagaactttgggaggctaaggcaggccaatcatccgaggtatctgaggtcaggagttcaagaccagcctgaccaacatggtgaaaccccatctctactaaaaagacaaaaaattagccgggcatggtgacgcatgcctgtaatcccagctacttgggaggctgaaacaggagaatcacttgaacccgggaggcggaggttgcagtgagccgagattgcgccattgcactccagcctgggcaacaggagcaaaactccgtctcaaaaaaaaaaaaaaaggtaatgaaacaaaacagttacattacctttgctgtaagacatctgcatctctgtgtctgaggatccagttactctgatggtgaacgacatgtcttggattggtacttattgctgtgactcctgtttatccttacacagccatcccttcttttcgatattgttcccctgtgccaacagcccttactgggctctaccatcaagtacaattcaggaaagaaggcagcgtttcattcttcacaccatgctttctcgtatggtctgtaggtttggtttgatgaagaattggggacacagagaaagccttggggtgggtagctgcctacctggtaagaattcagtggcttgggcaagggaagaagggcttgatgtagtgtccagacctgggtttgctctaactcctgccacttactcgctgggtcatcttgaacatcataacctctctgaacctcaatttactcatctgtaaaatggtggtattgttcctccccacagaacagagtaggccccccttattcttggtcttgctttctgtggtttcagttacctgcagtcaagcatggtctgaaaatattaagtgaaaaaatttcagaaataaacaattcataagttttaaattgcatgccattctaagtagtatgatgaaatgtcttgctggcccggaacatgaatcatctctttgtccagtttcttcgtgctgtctgcatcatccacccgtcagtcacttagtagtgatctcagttatcaccatcctggtatcccaacacttgtgttcaaggccccagttttacttaataatggccctaaagtgcaagagtagtgatgctggcatattgttatacttgttctattttcttattagttattgttgttcatctcttactgtgcctaatttataaattaaactttatcataggtatgtatatgcaggaaaaaacatagtatatatagagtttggtattatccatgacagtaccaggcatccctcctgggagtcttggatagtgtcccctgaggataagggggaccactgtagttgggaaaaagtcaatgataaagtcgatctaaaacaagttttcaacaaatattgttatttttcttctcctctctaaatcccatgtccttttcccccagcctaaacagcaatatttaaggcgtatttagcttttcattcttctctgggagataaagcatagcctgccaatatcactgagggatgtagcagataggcttatgttcagactaaggtgaaaataagcacctgatgattggcaaagaattgctgggcattgccatatgtaagacactgggcaaggcacactgagacgacgggcgcggggtcttcccttagggattgacagcctaactgagggacaatggccaattctgccccgtcatgacaagttagagcagcacaggccgagtgtgtgtggctgaggaggtggacagctgattccacggcctccccagggccagactggctaaaggggaagggagctgggtgccaagaggagagagaaagagcacaggaaaaggtgcctgctcagggagggtaggctgagacaacaggctttgttacttccacgtttcatgttgcttcaccatagtcctgacgtgcttccacagggggccattgccttcaaggcgatttctgcctttgagcccagtgtcgttctgctgaagcctgcagtggattaggaagcaaccaagaaccccattagggatttggagtttgggaacacttgctgatgatggttaccctaggctgaccagacaggacccaacaatatattcaactttaatttttttaatgtgaaattagtttttatcttataaaaagtttgcaaatgtggaagagttcaaaaatgaaagtagatgtcaccccaaatcttaaatcaaccagatatataaactattgattaactctttgggtatatttatttcatacatttcatgtatttgcacatccatttccttgacttgtaagtatccatatgagggttttatgttgttttatatttattttttgttgttttataaaaattagggtctactactagactcttacttggcaatttgatatttttcatgaacattacacacatttcccatgttgttaaatattctgtgtaatttttaatgatagcatagcctattatttagttatacccaaactcagttacccattttggggcatttcataacagtacctacatcacagggtggctgtaaggattgacttttgttctgaagcaattagaacattgcctgacacatagtaagcactgtacatgtgtttgccactatcaagttgaaaatgtttcattgctataagcaatagcagtaatgaccttatcaatatattttttccaatatctgtgtttatgattcaaatatacttattatttggaactctattttgtcaattgccaatacatagctgttgcccattttccttttggtgatgcttacatttttcctattgctttatataaatattaactgtttgatatatatgatgcaatcattttccttgtttttccatttgattcttagttttgttgttgttggttttcaggtacagaagttttatgtttcacataattatatatgactatttcttcattatgacattttgtttttatatcttaaaaaagatattccctacctcaagatcagataaaaatatttacctttatttttttcctgattcttttatggtcttatacatttaaatctttatctggaatttatttgattaggtggtgtggggaaagagctaattttattttcttttttgccaagtgttgccaattgtccccaagctgttgaacaatctcttcttactaatttaaaaaataagacttataatatgctaaatccctaaatatatatccacttgggtttgtttttatatcccttcatacaagagtatgtttttgtcagattgattaatttctgctaagactgctaattttacaacttatgttattttaaggcaatacaggacattgaaaaaggatgggccaaacccacacaggcacagaggcagaaattagaagctttccagaaagaagacagtcaaacaaaggtgaatcaaatattgctccaagagaaatcccttgaaagggagttaaagaaacatattagaattgaactgtttctgtaactgataaacctaccaagcactaaaagtggggctctttttaaaaaaataagaatatcttcattgattgttctgagtacagaattaataaaagcttattgtttaaagattctaaaaaaaatacagacggtatattgtgagtcctctgctgagttaattaatatagatcctccgcattatttttagtgactacagagtattccattttatggttatattatcgtttggctaaccacttttctattattggaagtcaggttgtttccagctcttgctgctataaatcactttggcagcaagagccatgaggcccagggctgtgtataatttatacatactctgtgtattcacagcacctggtacagttcctggctgaagtccctgaacatttcaaccagcatcctctttgagtacgtgttctattattccttaggatatatttctaaacattcatttttaaagtttccgtaaaggtgttaccaaatcacgtacctcctgcccccaagcagcgaatgtgtctgacagacaagacgtattttaacagaagaaatggcctctgttttgttgtgttgtctttttaaaaattcttctgactttgccaatgttcacaactgcaacattgatttttgaacgaaatacaaccaaaatttagaggactcatttatacgtaacagaaaataattcctcaaaggctcagacctttgagatttttactgatgaactgcaaaaagagaaaaaggaaaggcacatactgccacaatttaatatcccccccacctgccagcccagtgttctacctcagctttgtcacaaaaaaaaaaaaaagagttcagtttctctgtgtgtttgtaaattttaacaagtgcagcttctattttgatggatagaatattgctgttacttcagatgcaattacaaactgtgtacaccacaaccaagtcttcacacatatctgccctataaacttcttaatttagtaagactattgttcttaccatgccctgccaaaatgtgtatttgtagtttttccacaaaataaattttatcttctatgataaacattttatctgaatttaccatactatttgtaataatgctattttaaaaaagctttgctttgagtacataaattgaatttaaaaatttaattattattgagatttactttctctcaaagcatctacatgtactgatatgtaaccaacattatttgtttgtcaagttcttctgctaatggagcaaacacattaacaactatactttctgtacaagaaaacttggaagtgaaatgaatgaaattaacttaagaaagagtcatttgatctaaatcagagaaaggctgtggtccatgggccacttattttgcaaataaagttttattggcacacagttacaatcactcattcatgtattgtctaaggctgcttttgtgttgcagtggcagaggtaagtagttgcaacagggaccatatgtctgtatagctgaaaatgtttactagatggttctttacataaaagtttaccaatccctgatcaaaatgaaaatatattaatataaacatactttctgcagctgtgtatgttaaattgtcttttttaggtacaatcttaactaattttcaagtagagaatccttgtagaattctgtcttctggtgttcatatagttagtaatatcacaacacccttttatcgaatgtcaaatgccaacaggcattttacataagttacttactcatcaccacctttcttgcaaaatagagcttcacttttaattaaacaaacactttcctttcttttagctcattgcagccaagagattattacaattttaaagaagtgttatcaaacaataagataaacaattataaatttataccatatcacttagaaagtgttgtagcaaaagcatgacactactctctgtctgctctgtgacaagatgactcagctcctgcccccaatcactgcgcaagtaccatgtacttacaacctgtcctttctgatgtttctcactgacccaactgaaggccagcaccttaatgcatctcccaagctgaagcctggaccatagcacaatgagctggcacatgtggctggatgggacagtggctttgaatactcctgccagcatgagatcaggagtcagctgtcccttactgcttctgactcagcctgtttcactgtatcagagaacgcctccggagtccttgtaaaggaggtgtgagttaccttgcttcaagaaaggatcacaagttgtcactaggtagtcctctttctgatttaaccatgtgctaaagtgggaactctgttctccacatgcacatctcacataccattaggccaggcccatggcgaaagctggaagaacagagtggagttcaccaaacctataccagcttatttaaatgcaatcattaacaaaatggaaagccctggacagacgttaatgtgacaggatgccttgatcagtggtgtgaatgcaactgtcctcagttcttaggttacttcagaagcagagggaaaagctaaattttaaaagtcttccctgggcaactgggggaatctctggaattctatttagaaagcagaccagctcgtgccctcattgccatttctaaaatctctttctctggcaattactaccaccatcatataaagcagcctgtagaaatgaaccacttttcttcctacatagatctcagcttagttttttaaaagccaacattttaggccaggcacagtggctcacgtctgtaatcccagcactttgggaggctcaggcaggtggatcacgacaaggtcgggagatcaagaccatcctggccaacatggtgaaaccctgtctccactaaaaatacaaaaattagttgggtgtggtggcacgtgcctgtaatcccagctacttgggaggctgaggcaggataatcacttgaaccagggagtcggaggttgcagtgagccgagatcgtgccgcagcacgccagcctgggtgatagaacgagactccgtctaaaaaaaaaaaaagccaatgtacacttttttgtttacttgctattataatctgctgagacagaatcatatctgttcatccattttatggactcttttcttcattcttcatttactcatggaatattttcatttccactgtgtaccaagcaccataacaggggcagggacacagtggtgaaagaggcaggaatggtcccttccctggaaggacactccatgaatttcccccgggcttctggtgagcaccaggggcattatctctatgtgtaggatcaagaaaaggagctttcactgtgactcagttccatgtattatcctagaatggcagtagcttctgacatgaggttttcatctgtttcaagtggtcttttgcttcctcttgcctcccctccccccacatcaccctctttggagcagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttgtgagtatcttggcaccttgctttgcccatgacttaaaaatcctagtacccttggatgacaaagttgacactagggagacaggtttgccatttgaatctgtaccttgagtggagtgacatctaagccacattaaatatcacctagtggtaaaacctatctgtagtctgatgcacgttccccacccagagaagcagagacattgatctttccaccttcctaacaacaggcctccctactgcttgaagggtggctgtagtaataacagcagatggcaataacagctaccatttattgagcacttactacgtgctcagtgttgacaaggtctctacccttcaagactggcactgactggcagagctcttcttacaacaccttggcatcatgcttgcattgccagcttctcccaagagaaacccttattagatttattgagtgcccactttgtaccaggggctgcgctgcactgtctcatctattatttaattcagcctataagaccccagtgagctaagtggtgttatcctctttacacaggaaactgaggttaactaatagagggcaaaagctatcagagcatgacacccacttgttaaatccatggaatccctggcgattttttagctgggctcatacttgacctctctgtggcattcgatactgtcaaccatttcttacttctcaaagatctctctcctttctcccctacttttgtaggccacttctccctctgagcattcctgaaattctggtgtttctggcattgcattctagcatcattcctctacatattctctgaaatcaatgcccagaccctgctcaaaggcccagttttttctacctctggatgccttcaaccaggtgtctcacagacatctcaaacgcagcctttccctgaagcagacgagtccttttccaccttatgcctttcatggggttcttctgtctgtgttccctacttggtcaagggaacttccactaccacaccctaattgccaaaccagaaatcttgaagttatctctgacttttctctttctctgaccctacacatttaagtgctaatggaggcctatccattctatactttgctgtccctcaaaagtctcccttaccagcccaggcaacatggcaaaatcccatctctacaaactaatacaaaaataaaccaggcatggtggtgtgcacctgtggtcccagctactggggaggctgaggtgggaggatctcttgagcctgggaggcagagcctgcagtgaggtgagattacatcactgcactccaacctaggcaacagtgagacccatctgaaaaaaaaaaaaaaacaacaaattccctctatctccgcactcacagcttggtctcaacatgccctgtgtggatggattgaacagtttcctaattcttctccctacaccactctttcctcctggaggtcagaaaaaatatattgtatgatcttagccctttgaaacgtatggaaacgtgttttgtggccccaaatttgatctatcttggtaaatgtttcacatgtatcttaaaagaatgtgccttccattttgggtagaacattctataaatatcaattgccttagggattggctcatttttgctctgcataatttgttggaagttcattcaggttgctgactatatcagtagtttgtctctttttattgttgagcagcagtccatggtctggatgtgccaaagtttgcttaaccatttactcattgaagaacctctggttgtttctagtttttagctattatgaatagagctgctataaatcttcacatacaggtgtttgcctggccatgagtcttcatttttctggaataaatgcccacaagtgcaattgctgggtcgtacggtaattgcatgtttactttttaaagaaactgccgaattgtttttgagaatggctacatcattttacattcccaccagcaatgtgtgagtgaaccagttttctgcattctcaccagcatttggtgttgtcactattttttttattgtagtcattctaatatatgtgtaaagatatttcattgtgacttaagtttgcatttcactatggcttatgatgctgaatatcttcatgtgtttatttgccatctgtatatcttctttggtaaaatgtcttctcatatcttttacccatttttgaattggattgtttggctttttactgttgagtgttgagagttctttatgtattctagatacttgttctttgttggccatctggtttccaaatattttctcttactctatagtttcggttttgttgttgttgttgttgtttgtctgtttccttgttttggttttgttttgagacagagtcttgctctgtcgcccaggctggagtgcagtggtgcaatttcagctcactgcagcctccacctcccaggttcaagggattctcctgcctcagcctcccaagtagctgggattacaggcatgcaccaccaggcagggctaattttttgtatttttagtagagatgaggtttcaccacgttgtcctggctggtctcaaactcctgacctcaaacaatctgcctgcttcggcctcccaaagtgctgggattacaggtgtgagccaccacacctggcccactctatagtttttcatcctcttaaacaaggtcttttgcagatcaaaaatgtttcattttgattaaatctaattaatcagttttccttttttggattgtgcttttgccgtcaagtccaagaactctttgataaatcctgttatagatgctgaagtttttctattttttttcctaaaagttttacagttaggggttttacatgtaagttcatgatccattttcagttaatttttgtatggagcatgagacttaggataaggttatcaggccaggcacagtggctcatgcctataatcccagcactttgggaggccgaggtgggcagattggttgaagtcaggagtctgagaccagcctggccaacatggagaaactctgtctctactaaaactacaaaaattagctgggcgtggtggggcgcatctgtaatcccagctacttgggaggctgaggcaggagaatcccttgagtctgggagggggaggttgcagtgagccaagatcacgccactgcactccagcctgggagacagagcaagaccctgcctcgaaaaaataaaataaaataaaataaaaataaggtggttatccccccatccccaaccttttgtttgtttgtttgcctctggaggtccagttgctccagtacccatttgttgaaatgactgtctgtcctcaagtaagctatttatatacctttgtcaaaaatcagttgggcatgtttgtacgggtctgtttctaggttctctgttctgtttggctgatctatgtgtatattcccccaccaatatcacacgtgtctttctttataacggctttattgagatataattcacataccatacaattcacccatataaagtatacgattcaatggtatggtatgtagtatattcacagagttgtgcagccatcaccacaatcaattttagaacactttatcacctgaaaaagaagccccataccctttagttgtcactttcctatccccccagccctaaaaaaccactgatctactttctgtctctatagaatagatttgcctattctggataatttatattaatggacacatagaaagtccggcatgaggaggtaaccgcttgagctaactccgacccgtatattaatggaatcatataatatgtgatccttgtgactagcttttttacctagcatgtttcccaggttcattcttgtagcatgtatcatcagtactttattattttttatggacaaataatattccacttcatggttatagcacattctacccattcatccattgatagacatttgggttgcttctatattttggctgttatgaattatgctgctataaacatttgtgcacaagcttttgtgtagacatgtttttatgtctcttgagtatatacctaggagtagaattatcattggatcaaatgataattctgtgtttaactttttgaggaactgccagcctagtttccaaagtggctgcaccattttatatccccagcagcagtggagggttttgatttctcctcatccttgccagtacttgttattaattttttattatagccaacctagtagatagatgtgacacggtatcccattgtgatttcatttatctcagtattttttctctctctgctttatttgtggttgtttctattgctatagctttaagattattgatattttcttctgtaatgtctaacattgttatttatcccatccagtgcatttttacttctagtgttgtatttttcatctctagaagttctgtttagatcttttttatattttccatttctctccttatcatgctactttttttctccaaattcctgagtgtatggaacatactttaaatagcagtttcaatatttttgctactaattccatcatctctgtcatttctggatctaattctactgattgatacttttttctttttgctttctgtttgtttgtttttatcacctgacattgagtatgtactattgattgatttttctactgtttgcagatcatattttcctcctcctattcatttcaagtaattttttgtggcatgctaaacgttgcaaattttacattattgaatgtcgcattttattgaattcctttaaagagcattagattttattctggcatgcagttaaattacttaggattggttttatttttatttttatttttaagaggcagggtctcactctgttacccaggctggagtgcagtggcacaattatggctcaccgcagcctcaaccctgtgggctcgagagatcctccttcctcagcctcccaagtagctgggattacaagcatgtgcctatgcccagctgattttcattttttgtagaaacagggtcttgctatgtttcccaggctggtcctgaactcctggcctcaagcaatcatctgcctcaccttcccaaagtgctgggattacaggcatgagcccccatgcctggccagttttacttttttgatgcttgcttttaagctttatttccttcttttttttttttttttttttgagacggagtctcactctgttgcccaggctggagtgcagtggcgcgatctcggctcactgcaagctccgcctcccgggttcaagccgttctcctgcctcagcctcccgagtagctacgactacaggcgcctgcccgccttgatgaagttgcagagtaatctttagtctagggctaatttagccctttgtgccttagctgccattcttagagctctacctgacatcttgtctattgtctctctgctctggccaatgggaacatgaactctttccatccttgtttgtgagctcctgcaatttccaacctactgctttccagatgttctttccccagcctcatgtaggtttactctatacacgcgtagatcgttattcagccaaagatttgtcaaaaactccctagagctctcgctgtgtttaaagccctagtctttgatattctgcaccacaaattccaatctcaacttcttgaaacttttgccctttctcctctactcattaggacccctgggctctgtttgggttccctgtctttgtgttatatcctggaaacctcttcaggtggtaagctgggataattatggggctcacttcatttggttttccttctctctgggttaacagtactgcgttatctgttgttcagtgtctgaaaacagctgttttccaattcatattttgttgttgttgttgttgttgttgttttcgagatggagtcttactctgttgtccaggctggagtgcagtggcgcaatctcagctcactgcaaccttcacctcccaggatcaagtgattatcctgcctcagcctcccgagtagctgggattacaggcaccagccaccatacccagctaattttttgtgtgtttttagtagagatggggttttaccatgttggccaggctggtctcaaactcctgacctcaagtgatctgcctgcctcagcctcccaaactgttgggattacaggcatgaaccactgcacccagcctccaattcatgttttaactgatgctgccagaccgatatttctaaaatataaatctaattcctgttttttggagacaaggacttgctatggtgcccaggctggttttgaactcctgagctcaagagattctcttgcctcagcctcccaaagtgctgggattacaggcatgagctaccacacctagctgaaacctcttaaagaaaatctgttgcccttaggataatgtctgttgccccctagggggaaaaatatcttttttctttccctatttcttttttgtgtactgcatataatctgcaggaagggatccttagcttataaaacctgtaagagttagggctctttgttggcaagcaatagaaaccaacacattggactctagtggaaaatgggatttattggaaggatatggagtaacctacagattcaaaggaaaaacggatgcagaggctttagaaagttaagaaccaaaggagctcaagctttctaagaaataggaactctatcaggacctaccatttgggtctctctgactggaataacatgaggagcatagagaattacttgtccacttggcctgaaatttggtcatatgccatcctctgacttttcattccctgatagtcctacataaatagccaacagtggaagagggatggtttttccaagggtatttgagactccattactaggaaaaagaatgatggatgctgcaaagcaaaaatcacagatgttgcctaccaggctttcaggatctggtcctaagcctcttctcatatcaccctccatgccttggagcctgtactgcagccacatgcacagtcccttgtagtgtctccaacatgcctcaggacatttgcacttgctagaatatttcctctttcaaaaatcacctctcacctcccctacacactacaaaataaaaccaccacgacaaacttgggtagtttctacctctgctcagatggcccttccaggaagtcttcctttgccctcctagcctgggttaggtgcccctcctatttacttccatagacctgtgtttccttcctaacacttaactattaatatatcaaactgtggtgatttactttcatggctcctccatagactgataccttcttggaaatagggacagtctccctcattttgatattttgcccaacacattaatgggctttttttttttttttttgagacgaagtctcactcttgtcacccaggctggagtgcaatggcatgatctcggctcactgcaacctctgtctccctagtgcaagtggttctcctgcctcagcctcccaagtagctgggattacaggcccctgccaccacgcctggttaatttttgtatttttagtagagatggggtttcaccatgttggccaggatggtctcgaactcctgacctcaggcgatctgcccgcctcagctgggatttcaggtgtgagccaccgtgcccggcaaattaataggcatttaaatttacattgaatataaaatattttcctttgtagggaactctgctggatacggatgggccccagagaactctcaaccagaacttagagctcagatttcaatacagtgaggatagttgctggcagtggtttgttatttacaccaaacaggtgagttctcagggcagaccttgaacaccctctgtgctgaaatgctgtcttgcttgctggggtggatgaagcacatgaccctaacccaactagagcaggaccctaaagtgttctatgcactctcgttcgggaccgtaataccttttattttgttttatgttttgttatattttactagtcaccgtggcctttgtatcagttagaaatgaatttagttaccaattaatagaagattcaaccaacagtggcttagaccaggagtccatagactttttcttaaaggatagtaaatattttaggatttgagatccatacagtctctgttgcaactgctcaactctgttaaaagcagccataggcagtatataaacaagtgagtctggctatgttccaataaaactttatttatagaaacagatggtggtctggccttgtttgccaacccctgacttaggcaatacagatttttatgatcttagttaataaaaatactgaaggtagatgattggcatccctattattctcttgaccttttccaagcagataaaaagccactggttgagtatcccttatcccaaatgcttagcaccagaattgtttccaattgcagatttttttaaatcttgaaatatttgcatatacattcatgtggtacataacattttggtcaatgacagtctgtatatatggcagtggtcccataagtttataactcagtatttttactgtaccttttttatgtttttttttaatgtttcacctttttcctgtagtaccttttctatgtttaggtgatacacatacttatcattgtgttacaattgcctcagaatttattcagtatagtagcatactgtacaggtttatagcctaagagtgggaggctctatcatctagcttaggtatatagcaagctataccatctaggtttgtgtaactacactctatgttgtttgcacaatgacaaacttgcctaatgatgcatttctcagaacatacccccatcatcattaactgatgtataattgtatataatgagatatcttgaggatgggacccaagtctaaacatgaaattcaattatgtttcatatacaccttaaacacatagcctgaaggtaattttatatgatattttaaataaatttgtgcatggaacaaagtttgtggacattgagccatcagaaagcaaagatgtcactacctcagccacccatgtggaccatctgtggttgtcgggcatcaccatcattcctgactctgaatttatatgctactgataagcaatccatttcttatacttattcacatatacataatcaacagtagaaaacatgacgtaccattaatgcagtgaaaaattatgtgttcagggtagctaatcagcacaatagcatcactggaatacctgtatcagctgtgaaacctgtgaaacaacagcaacagaatctgtgctgtacatctggtttttgactgttactagtcacaggagatcaggtgtggaatttcccacttgtggcatcatttaagtggctcaaaaagtttcacattttggacttttggattagggatgctcaacccatatctctcttatctggaaagcaaaagttttaccccagaaaccccgcagtagacttcctattatgtttcaatggccagaactggatcatatgaccactcctagctgcaagggagtctgggaaccaagcatctagcaaagagaaacaggatttatgattggcttagagtaagcatgaaccattgcctggggctgagcatgttatcgtcccaaacaaaatcagggtctcttaggaaagaagaaggggcaatggctgttgggtagccaactatccatgtctaccataggcttttaactaaaattggagtggaaatgctaaaaaagagaaaatctaaacaccaaatccaattgaaaagtcctttttactaaattaagccatttcaaattgaaaccaaaattgtaggtgttctgaaatggaatcaaaatagtaaagtactctttgcatcgatgtcatattcaacttgagtctctggtgatcaggctaagttccatggaacattctggttcagaaaccaaggccccttttgactctttacttctagtatagttgagtcattatatcaaagtcctctgaaaacatgaagtactaaaccaaaattctaggttaaaggagtgggtccttaggtccaccttaagtatgaaacatctttggggaaatagtagactggtttgctaaggcaagattatcagtcacttggagagacatagagagatttgggtagtaaaactacctcccaacctcagaatgctaagtgcggttaaattttactatgatttttcaatctaggcagtagcaaatgagtttaaaccaccataaagaggtgcaataaacattctttcaaaggattcctagtaaggtcttatttcccctggagtgtgagttttattgatgtacacccaaaggctactttttaaaaacattataatttttatggatatataatagttgtacacactcaagggctacttttgtaaaaggtggaaatgtgacttgtgtgctttgcaaatacaaatgagggcttgggcccaaatctttttgagaccttttaaatgaaatctgaattgttggccaggcgcagtggctcatgcctgtaatcccagcaatttgggaggccaaagccggcagatcacttgaggtcaggagcttaagaccagcctggccaacatggtgaaacaccatctctaccaaaagaacaaaaatcatctgggcatggtggcaggcacctgtaatcccagctactcgggaggctaaggcaggagaatcccatgaatctgggaggcgaaggttgtagtgagccaagattacaccactgtgctccagcctgggcgacagagcaagactccatctcagaaaaaaaaacaacaactcgatccttttgctttgtcttttttaaattttttattcattttcaatcttttcatatttaataaacctgacagtttatagcagagtcctggcctatgtacttgtgtacattgtataagaatatggaattggtctgcatcttattggaccctattaaacatccttcctagctgcatttgctcagggttttgttgtttattttattatctggttttgcataggtttcatatatgcacatataaacagggctagttcttagcaaagctaggaagtcaaaatgtttgcacaaatgccccatctgttaattctttcaaaaattgatgtcaggcccttttttctctcttccctcttttccccttttaaataaaattaattcctgtaatgctctacacccctggaagacattgagagctgtatgtagcccattttccctctaattctgctttctgtgttctcccctccaagaacttcctacttggctaccaccccagcctgtgctttctctcactctctcctcccttctcctctccatcctcccctccaacacagtgaccacccctgaacacagccctgcgctaagttcttctagcctcaactttgattggcagttgtcccaaaccttagtagggccaaaggagaaaacagcaggccaagaattaagagcaggacaagagagaaaaaggataagtgggaaaggagcaaatgggaaaatcacagggaaccttcaattttgctcatagtattgaagagcctggaataaggaagcccagcttttgtgtagcaagttgtacaactatgagtgtcttggcactaatgatgatttagccacgaaggatagtgaaggtgactatgagtctagaacatgagtgattaaagatactagaaaaataagaaagtgggccaggcacggtggctcacacctgtaatcccagtactttgggaggcgaggcgggtggatcacttgaggtcaggaatttgagaccagcctggccaacatggtgaaaccccgtctctactaaaaatacaaaaaaattagctgggcatggcagcgtgctgaagcgggagaatcgcttgaaccaaggaggcgggggttgcagtgagccaagatcgcagccacagcactccagcctgggtgacagagtgagactgtctcagagaaaaaaaaaaaaaaaagaaaaagaaaaagaaaaataagaaagtgaagtgaagaaaaacagctgatcttttttttcagtttagtaaaagcaataaggtgctaatatattccttcaaacaaaccagttacttttatgcccagtagaggtctctcaataattatgtatacaatgtctagaattaaatataggattgaccatcatcagttcatctcattataataataataattagtttttattgtttattgctcataaaacattatctgcttacaaaataatagaaaacatgggatgcaagggggtgagttttaagaggaaaaatgttaatagtgagatcctggacatttttcatttctttaaaaaatctgctgtaaatatatccacataattgagaaaatttatagttacttactaattggatcttatgaaaacttctagaggttaatgaagaaatctaaattcttgaatctgtgttattggagggcagagtcaaaatccgctttgtggtgtgaggagggaagaaagagagtgaagatttcttcggttacaagagttctttattcctgcatttcttaggcttttttgctgagtagctgcttgaaaaagatgatctcagaaaagatggtaaagctagctgctgagaatacagaaatggtgagtgctcttatctgtgtctatttttcactttacgttcccactatcagccaacagttggagaccaaactacactcatgagctccctgagccagcaggtctagtcctaaagggaggactccaaaccacagaagtgagctcctcttccctctggtagctcagtggtcaggatggcagggcagaaggaagcctgtctttagaattgaagtcatttttccaatgagaagtcatctttgggttactgagaattctaaccctcgactttgtatcattttgtttcagccttctctgacatggaggctttcagatttattacagaagctacatcttcaagtcagggtcttgagggggtctttaacacagtggggatgatcttattataagtttatctctagaaagaatccatagcttcttgatacttccattgtgccaaatgaaaatgcctttaacagttgggggaggtagtaaaataaactctcaaggctattttttttcctcaatataaaattaaactttattgttctagtgtttatttattattatatttattaaaggcctagtaactcatcaaaaaggttggtgagaaggctgtgaaaaaattatattttaaactgttttaattgcctagtcgttatcatgatacaagtatgtcccaaacaagacagtacaattttttttttaaatgattagaaataccaatgcctggggccgggcatggtggctcatgcctgtaatcccagcacttcaggaggccaagtggggggatcacttgaggtcaggagtttgagaccagcctggccaacatggtgaacccccatctccactaaatatacgaaattaactgggtgtggtggtgggtacctgtagtcccagctactggggaggctgaggcaggagaattgcttgatcccagaagacagaggttgcagtgagccaagatgacaccattacattccagcctgggtgacagagtgagactccatcttaaaaaaaaaaaagaaagaaagaaataccagtacctggttgacattcataaacttaattcttttgtagaatattatattgatattttaaaatataatagaaaatattgggaaacttttcttttcttttcttttctttttttttttagatggagtctcactctgtcgcccaggctggagtgcagtggtgcatctcagctcactgcaagctccgccttccgggttcacaccattctcttgcctcagcctcccgagtagctggggctacaggtccctgccaccacgcccggctgattttttgtatttttttttttagtagagacagggttgcaccacgttagccaggatggtctcgatctcctgacctcatgatccgcccgcctcggcctcctaaagtgctgggattacaggcatgagccaccgcacccggccaggaaacttttctaatgttttcatttaaatttagactaagaggatggatgacatctttagttaacattgatctttacttgactttccagcttttttctaagaaaatagctgtgttttgtaattatttctctttcttctagaactgaacgtaccttttccagggaaaataaattcactgcctcttggtgactgaacaattcaagatgtgctagagagtagtaaatcaaagcaataaaagaatcaaggaaactctttttaaaagagtaatataataaaatccaacctctcaggcaggatggaccctcttaggctgagattattgtatgtattaaaaagaagaaagagaaaagtaattaactgaagtagcctcattaaaagggagaagtgctctcaaatgtggatgaaaaaaatgtaagctacttgattcaggaaatacttgtacaatgagtagctaaagagttaactcagtaaaatggagaaagtagtaatctatttaaagttttcaagaaaaacaaccacactatgtatcttaagtttgcacatgaatcgaaatccataattaatctctgaggttagcaaaatcagcacattagtcagtacccttgtattgctttatccaaatatttaacacgttttagttccagaaactctttattttttttacttattttggctcttggaatgaaaagttcagacctttcattttgaaaattgggtttccaagaggattttgtaaggatagtctgcattttaatctcgaattttatctacaaagctctgggtagaggggaacctgggaggtagagagagcagacagttcagtgtttgaactcatcctgagtgctgggccccctcacaagtacagtcgattaaagtcattttgtggctcaaggaaaccatataaatgtaccatggcgtcattcccttgttttccagggaaacacacaaagtcaaaactgacacatagcacttatagaaggcttgtatggactaggacacagaggtctctattttgcagggcaggttccgagtccaagattttgatcatcttaaagaatctgaagcaggggagagaactgtaaccaaatgagccccataaataaggcagatcatccctagaagcagattaagtagtgctagttttatcctagtaagaggaaatgagggaaaaaagaaatgtattgttaacttaattagctttgttagctttaggtaatgttttcaaagataaaacttgtgctctgtttatgaagacatcattaaaatttgggtcaagcaaatgcactaaagaataatgtaaacatacagccacaacaaaaatatattaagttcttaaattatatatatatatatatatagatagatagatagatatagatatataaaaaatttttttaaagacagggtcacgctctgtcacccaggctggagtgcagtggtgcaatcatgtctcactgcagcctcaacttcccagactgaggtgatcctcctacttcagtctcccaagtagctgggaccactggcatgtgccaccacacccagctaatttttttttttttttttgtagaggtaaggtctccctgtgttttccaggctggtcttgagctcctgaactcaagcgatcctcccaccttggcttcccaaattgctgagataacagacatgagccactgtacctggcccttaaaggcaatattaaccataaactggaagaaaaaaaaagtgtaacattcttcttaaagctatgctcctgtacaaaagcctgaatcaatttccttaatatttgctgctcttaattagagcagaattataaaggattgctttatttaaaaataaagtatattagttagagttaggttttgctgcatgtaatagaaaacaaaagacaaaacaagtgtcttagacacaatgaagtttgtttctctctcatctaaaagaagtccagaggtaggcagtctagggctggatggggtggctccataatatcaacacagacctttctattgtggatcttctgtatgtggctttcacctcatccccaaaatggctgccagaacaccaatcattacatccacattctaggcagcaagtatgaggaaaatatgaagcagggttcacttcttttctttaaggagaagtttcagaagtctcactcagaatttcccctacgacaattggccaagagatagtcacatcacaggcccacacctagctgcaagggagtctggtaaatgtggtcttttagcagggtgtgttgtctattcaaataaaactgggtgtaattactaaggaagaagggtggaatggataatggagtaaactaccaacaatctctgccatttagagaattccaaaagacaccaagaaaagatagtagatgtattttatgcaatagatgtgttcctaaggaatttctgaaagtgcattattattattttacatattgaactgtaatctggatacatgagatgtacatcaggagtatgctggtcaattattttctgacttaaaaagactgtttttttttttttttttttttaaagacaggctctgtctcccaggctggagtgcagtggtgcaatctcagctcactgcaacctccacctcccaagttaaagccatcatccccactgcagtctcctaagtacctggtactataggcacacaccaccatgcctggctaatttttgtattttttgtagagacaggggtctcactatgttgcccaggctggtctcaaactcctgagcttaagcaatcagcctgccttggcctcccgaagtgctgagattacaggtgtgagccaccatgcctggcaagaaacaatttatatttctaataatctatacctagtttgtatattttccctttgtttttcttaaaagtagatctgatctcaaaattagtttccctcaaaaatggcgaagaacaagatggctttctgattcctgattaccttacacctcttactccatcctcaactaccatcaccagatgtatttttccctccattcttctttccttttaggcaaggtgaaactatttaaaaggcaactggcaattttaaacatgtttctattatatagtgaggaggggaaacaccaaggacagtggcctctgatatctgaggaatgttagccttttgaagagctggtccaatatagaaaatggaaaaactgtgtatggcagtcaggagaatggtatgagcatagcaggaggacacagttttagacagccagggggaaattactgtgcaggaataagtgattatgttattaacagaaaccactctattgatgaaaaaggaagtataggaatactgcattatgaaaaaagatttgcttgtttccccagctttattccccctagtacataaagtattgaaggccttattgcaagaagtcaaggaaactgattatgtcagaaattgcttaacatttgtagtggttcgattttatttactttgacatagggagcaggaggggaaggagactaggagacagaaaaattctgagaattttcctccaagctctgtatttcatggctgcaagactatttatggaccctaatgtaacactgtaaaataataataatagtagcagaacacataagacatcagagtgttaatttctcattttccaagacttaataactggttttttaaaaaatattgaggccgggcacagtgtctcgtgcctgtaatcccagcactttgggaggccgaggcaggtggatcacttgaggtcaggagtttgagaccagcctggccaacatggtgaaaccccatctctaccaaaaatacaaaaattagatgggcatggtggcgcgtacctgtattcctagctacttgggagactgaggctggagaatcgcttgaatccaggaggtggaggttgcagtgagccaagattgtgccactgcactctagcctgggcaacacagcgagactctgtctcaaaataataataaaataaaataaaataaaataaaataaaataaaataaaataaaaaatcattgaaataggcttaaatatgtgaacatttccattaagaatactaacctaaaggaagtcttatgcatacctccttaaagcaattgattttacaacaaagttaaccatagttgaaaggtaatgcttttttgcagtgtcatgttatttagcccacttatttttaaatgtctccgtctatattctcatgagaagtaagcaataataaacaattaagtcacttgtttattctgtcatttatgaatgcctgtgtgtaccatgtgatggctaaacctgaggatccagagtcaaagagctaatatgttggaggagaaaggcgattaatacagagacgttgacaattgtagggtaaataaatactgcaacttgcttgagttatgtacctaacgcacatagcagttcttttctttcccattaagaagagtctaagaactctttccccaaaaagcctggctaggtggtgtttactaggtgtgccaggcactctgcctttccagattcactcccactctgctctgtgccctgggagactgtgtactacaaccttaccctcaatgggataactcaagcttgtccaacccacagcctgcgggctgcatgcagcccaggacatgtctgaatgtggcctaatgcaaattcataaactttcttaaaacactgagtgtttttttgtgatttttaaaaagctcattagctatattacatggggaccaagacaattctcttcttccagtgtggtccaggaaagccaaaagattggacatccctggataactcattgggaaaccagcaggagattggagggtgggagaaaagtgagagtagggtgtttatttctccatgttggaacctgctgggtctctggggctggaatgtctctctactgagggatacagctcccgtcaggcaatctctcctccttatagctacagctactctctggttccagccccagctgctccctcgccccttcaggcctagaggtggtaagaatcctctggaaatccccctcattgctagcccctgggggccccaacatcccttcatgcattcaatgtaatcctgcccacacctccattaaatagttaaacggttccttcctaaaattctcctcaattaccccaagattgcaccatctgtttcctgctggtatattgggtttaccttatgtacatgaggtatattcaagtgccttgaacttcgctttgattcttcgtttgattaatggtggcttttgattaaccaaagccccgctgggctttgagtcagcatatggattgcaaccccaagaattatttcaggatttagaaggacatttcatttcgtgtgatgttcttttaaaagctttcttcaatcacaaaatccataggcaaccactaatgtgaaacattaagttttacttaacttttggggactctatttctgtaacatttagaccctgacaagtgaaagaggaatgcacagatgacaagcaggtgtacctgctgaccggcagcctttgggacgattaagaggattatcgtggaagggaaagtgtgctagttaaatagattgtttgtgtgcttgcttctctgggctgagctgactgacatttcactaatctatctagcagattgaagttccggaacaaagcaaaagtaaaaaataccacattcaacaaagccaggtctgtgagtaaaattatgtaattggtacattataattttgataaatctgatcttttttcctctttaaccaaagtcatctcactttcaataataagtcagaattatgtttctcagaagctcctctttgtagattgggccaattggaaggccatcacagaagtatagtatttttattgtagcaccccatagcactaccaagaatttttacatagaaaatttccaagagaaacacaaaattatttggtgatttttttgtacaccccttgcactttttggaggcaactctctttctaatttgtatatgttacatatctagtatattttggtctcatagttttctgcagtatactctgtataaagcaacttttaagtttacaaaatactttttgagcatttagatctgctgtgcagataataatagaaaaaatcacaatcaatgacatttttgagcactcattattgccaggcagtattctaagcacttttatgtgaattaacacattccttcacagccctataaataagttgaggaaattagtgcacagagaggttttgtgacctgcccaaggttgcacagcagtcaaagatggaaagaagcaggcagtctgaccctggaactatgcccttaactaactgtgcccttgctaactcttcctttctaagtccaaatcctagtgtaggtgaatgaaagaaaagtgacttctaagtagcatttgaatgggatttcttcttgatccagcacctgtcacagaactggtgtgtatgtaaacatccttagtatatatgtacagtatttataaatatgtaagtatataaagtcctttcttgaatgaatacagtcagggaaaataaactagcagaaatgcataaaagcattctccttcataatcacagcacttctggctggttggacagagagacgagataggaactccactgcttactggctatgtgtcattaggcagatccaaaacctaacttcattagggactctgatactgcacttccatatctttgtctgtaaaatgtagatggcaatcacttcatcattttaatgcacccattttagcagcatgccgacagcatggagctgtggttctcaactttggctgcacattggaatcacctggggagctctaaaaactaatgcttgagccccaccctcagaaatttggatttaattggtctgaggggcctgggcaatggaatttttaaaagctccccaagtggtcctattatacaaccagaattggaaccattatcctagaacaccagttctcagtgtgtggtccctggaccaacagcatctgtatcacgtggatcttattagaaattcaaattctcaggccccaaacctactggatcagcagctctgggggaaggccgcagcaatctctttaacacgcccaccagacaaatctgatgcatgttcaagtttgagagccactgtcctaggacaacagataacactcagcacaactgtgatcagttcagttgtcctctcggatgagtggtaactctaatacaggccaacctatctcatgctgtgagtaggaccagcaggtcggaaagagacctagtgtccaactatattgagttttaatttattttgcaaactgttgtatagaccttatcctgagccatgaactgctataattactttttatgtataactcgtttaatcccaataaacaaccaaagcactgttattatccttggcttactgcacagagaactgaaacacagaaaggttaagtcacttgctcaaggtcacacagtcagttaatatcagagccagtatttgaacccaagcagtctttatttgttgtttaacaaataaaattagtttgttgctttaaccacttggcagtgaggcccctctatcaaaacaaatccctcgtagaaaaaaagttgtagcccatctgcccactgaggggctccacattttttttttcactttccactttccataaccgtgtctttgagatttcataagtactgaaggcaaattactctttaaagatttgcggtaaccctaacctctaaaatgttttaaaataagcataacactttttttttctaatgagacagagtctcgctcccttgcccaggctggagtgcggtggtgccatctcggctcattgcaacctccacctcccaggttcaagcgatcctcctgcctcagcctcctgagtagctgggattacaggtgtgcaccaccacatccggctagtttttgtagttttggtagagatggggtttcaccatgctggccaggctggtctcgtactcctggcctcaagtgatccaccacctcagcctcccaacgtgctgggattacaggcgtgagccactgtacacggcctcttctttttttttttttttttagacggagtctcactctgttgccaggctgaagtgcagtggcacaatcttggctcactgaaacctctgcctccagggttcaagtgattcccctgcctcagcctcccgaatagctcggaccacaggcgccagccaccatgcctagctaatttttttgtattttattagagatggggtttcaccacgttggccagggtggtcttgatctcctgaactcgtgatctgcccgccttggcctcccaaagtgttgggattacaggcatgagccactgcgcctggccgcccagcctcttttttaaagtttgtatttgtgtggaatgtgcactaaagattttgggcaaagttaaaaattgaaagtcgcatggctttaagaggggaaagaggcaagacaggtagagttaaatgttaacctgggtgatatcccagggccctgaaagatgcagaggacacataaaaccagtaggcggtgctcttctcagtcctaacgagtgtatttacactcaccccaaaataaagcttctacagaataaaactgtttaaaataaccattgcttatacaaatgtaagctttctgttgccctttcaatactgttttaacctctgtgactttgttattgttatggaaatgatttcctttcatttacatttctgacctctctgtttacttcacagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccagtgaat

(The sequence listing continues in the following parts.)

The invention claimed is:

1. A kit consisting of ligands that quantitatively detect or identify every one of 121 target isoforms of a glioblastoma (GBM) isoform transcript signature SEQ ID Nos: 1-78 and 95-137, wherein each ligand is a nucleotide or oligonucleotide sequence that binds or hybridizes to a single said target isoform, wherein each ligand is 17 to 30 bases in length, and wherein at least one ligand is covalently joined to a detectable diagnostic label capable of generating a measurable signal; and optionally at least one assay component selected from a substrate for immobilization, a substrate for an enzymatic label, a reagent for conducting an RNA-based assay or an RT-qPCR assay, and computer software.

2. The kit according to claim 1, wherein at least one ligand is covalently attached to a glass or plastic substrate.

3. The kit according to claim 1, wherein each ligand identifies the level of expression or activity of a different target isoform.

4. The kit according to claim 1, wherein each ligand is a PCR oligonucleotide primer or probe, or a pair of PCR oligonucleotide primers or probes that binds to or hybridizes with a single isoform target.

5. The kit according to claim 1, wherein said substrate for immobilization consists of a glass or plastic substrate upon which at least one ligand is covalently attached.

6. The kit according to claim 1, wherein said substrate for immobilization is a microfluidics card, a chip, a bead, or a chamber.

7. A kit consisting of:
(a) ligands that quantitatively detect or identify every one of 121 target isoforms of a glioblastoma (GBM) isoform transcript signature SEQ ID Nos: 1-78 and 95-137, wherein each ligand binds or hybridizes to a single said target isoform, wherein each ligand is 17 to 30 bases in length, and wherein at least one ligand is covalently joined to a detectable diagnostic label;
(b) at least one ligand that binds to, or hybridizes specifically to, a single control or housekeeping gene sequence of SEQ ID NOs: 79 to 94; and
(c) optionally at least one assay component selected from a substrate for immobilization, a substrate for an enzymatic label, a reagent for conducting an RNA-based assay or an RT-qPCR assay, and computer software.

* * * * *